US011566253B2

(12) United States Patent
Jacobsen et al.

(10) Patent No.: US 11,566,253 B2
(45) Date of Patent: Jan. 31, 2023

(54) TARGETED GENE DEMETHYLATION IN PLANTS

(71) Applicant: The Regents of the University of California, Oakland, CA (US)

(72) Inventors: Steve E. Jacobsen, Agoura Hills, CA (US); Javier Gallego-Bartolomé, Beverly Hills, CA (US); Ashot Papikian, Glendale, CA (US); Jason Gardiner, Los Angeles, CA (US)

(73) Assignee: The Regents of the University of California, Oakland, CA (US)

( * ) Notice: Subject to any disclaimer, the term of this patent is extended or adjusted under 35 U.S.C. 154(b) by 9 days.

(21) Appl. No.: 16/480,623

(22) PCT Filed: Jan. 22, 2018

(86) PCT No.: PCT/US2018/014741
§ 371 (c)(1),
(2) Date: Jul. 24, 2019

(87) PCT Pub. No.: WO2018/140362
PCT Pub. Date: Aug. 2, 2018

(65) Prior Publication Data
US 2019/0352654 A1 Nov. 21, 2019

Related U.S. Application Data

(60) Provisional application No. 62/450,929, filed on Jan. 26, 2017, provisional application No. 62/547,053, filed on Aug. 17, 2017.

(51) Int. Cl.
*C12N 15/82* (2006.01)
*A61K 38/17* (2006.01)
*C12N 15/86* (2006.01)

(52) U.S. Cl.
CPC .......... *C12N 15/8213* (2013.01); *A61K 38/17* (2013.01); *C12N 15/8216* (2013.01); *C12N 15/86* (2013.01)

(58) Field of Classification Search
CPC combination set(s) only.
See application file for complete search history.

(56) References Cited

U.S. PATENT DOCUMENTS

| | | | |
|---|---|---|---|
| 4,500,707 A | 2/1985 | Caruthers et al. | |
| 4,683,195 A | 7/1987 | Mullis et al. | |
| 4,945,050 A | 7/1990 | Sanford et al. | |
| 5,268,463 A | 12/1993 | Jefferson | |
| 5,399,680 A | 3/1995 | Zhu et al. | |
| 5,436,327 A | 7/1995 | Southern et al. | |
| 5,466,785 A | 11/1995 | de Framond | |
| 5,563,055 A | 10/1996 | Townsend et al. | |
| 5,569,597 A | 10/1996 | Grimsley et al. | |
| 5,604,121 A | 2/1997 | Hilder et al. | |
| 5,608,142 A | 3/1997 | Barton et al. | |
| 5,608,144 A | 3/1997 | Baden et al. | |
| 5,608,149 A | 3/1997 | Barry et al. | |
| 5,641,876 A | 6/1997 | McElroy et al. | |
| 5,683,439 A | 11/1997 | Jensen | |
| 5,689,049 A | 11/1997 | Cigan et al. | |
| 5,689,051 A | 11/1997 | Cigan et al. | |
| 5,700,637 A | 12/1997 | Southern | |
| 9,890,364 B2 * | 2/2018 | Joung | A61P 35/00 |
| 2001/0010913 A1 | 8/2001 | Hillman et al. | |
| 2004/0253623 A1 | 12/2004 | Choo et al. | |
| 2013/0323220 A1 * | 12/2013 | Joung | A61P 25/18 |
| | | | 435/375 |
| 2014/0068797 A1 | 3/2014 | Doudna et al. | |
| 2017/0016017 A1 | 1/2017 | Fromm | |

FOREIGN PATENT DOCUMENTS

| | | |
|---|---|---|
| WO | WO-2016011070 A1 | 1/2016 |
| WO | WO-2018053037 A1 | 3/2018 |

OTHER PUBLICATIONS

Li et al Nature Genetics 48:687-693 (Year: 2016).*
Altschul et al., (1990). "Basic Local Alignment Search Tool," Journal of Molecular Biology, 215:403-410.
Altschul et al., (1997). "Gapped BLAST and PSI-BLAST: A New Generation of Protein Database Search Programs," Nucleic Acids Research, 25(17):3389-3402.
Amabile et al., (2016). "Inheritable Silencing of Endogenous Genes by Hit-and-Run Targeted Epigenetic Editing," Cell, 167(1):219-232.
Anders et al., (2015). "HTSeq—a Python framework to work with high-throughput sequencing data," Bioinformatics, 31:166-169.
Belanger et al., (1991). "Molecular Basis for Allelic Polymorphism of the Maize Globulin-1 Gene," Genetics, 129:863-872.
Berger et al., (1989). "Expression in Transgenic Plants of a Viral Gene Product that Mediates Insect Transmission of Potyviruses," Proc. Natl. Acad. Sci., 86:8402-8406.
Binz et al., (2004). "High-affinity binders selected from designed ankyrin repeat protein libraries," Nat. Biotechnol., 22:575-582.
Bogdanove et al., (2011). "TAL Effectors: Customizable Proteins for DNA Targeting," Science, 333:1843-1846.
Chen et al., (2013). "Fusion protein linkers: property, design and functionality," Advanced Drug Delivery Reviews, 65:1357-1369, 32 pages.
Chen et al., (2014). "Induced DNA demethylation by targeting Ten-Eleven Translocation 2 to the human ICAM-1 promoter," Nucleic Acids Res., 42(3):1563-74.
Choudhry et al., (2016). "CRISPR-dCas9 mediated TET1 targeting for selective DNA demethylation at BRCA1 promoter," Oncotarget, 7(29):46545-46556.
Christensen et al., (1989). "Sequence Analysis and Transcriptional Regulation by Heat Shock of Polyubiquitin Transcripts from Maize," Plant Molecular Biology, 12:619-632.

(Continued)

*Primary Examiner* — Brent T Page
(74) *Attorney, Agent, or Firm* — Morrison & Foerster LLP

(57) ABSTRACT

The present disclosure relates to the use of recombinant proteins for inducing epigenetic modifications at specific loci, as well as to methods of using these recombinant proteins for modulating the expression of genes in plants.

13 Claims, 69 Drawing Sheets

Specification includes a Sequence Listing.

(56) References Cited

OTHER PUBLICATIONS

Christensen et al., (1992). "Maize Polyubiquitin Genes: Structure, Thermal Perturbation of Expression and Transcript Splicing, and Promoter Activity Following Transfer to Protoplasts by Electroporation," Plant Molecular Biology, 18:675-689.
Cokus et al., (2008). "Shotgun bisulfite sequencing of the *Arabidopsis* genome reveals DNA methylation patterning," Nature, 452(7184):215-219, 12 pages.
Cong et al., (2013). "Multiplex Genome Engineering Using CRISPR/Cas Systems," Science, 339(6121):819-823, 9 pages.
Conkling et al., (1990)."Isolation of Transcriptionally Regulated Root-Specific Genes from Tobacco," Plant Physiol. 93:1203-1211.
Corpet et al., (1988). "Multiple sequence alignment with hierarchical clustering," Nucleic Acids Res., 16:10881-90.
Curtis et al., (2003). "A Gateway Cloning Vector Set for High-Throughput Functional Analysis of Genes in Planta," Plant Phys, 133(2):462-469.
Deltcheva et al., (2011). "CRISPR RNA maturation by trans-encoded small RNA and host factor Rnase III," Nature, 471:602-607, 19 pages.
Eisen, (1998). "Phylogenomics: improving functional predictions for uncharacterized genes by evolutionary analysis," Genome Res., 8: 163-167.
Esvelt et al., (2013). "Orthogonal Cas9 proteins for RNA-guided gene regulation and editing," Nature Methods, 10(11):1116-21, 19 pages.
Extended European Search Report received for PCT Patent Application No. PCT/US2018/014741, dated Aug. 31, 2020, 11 pages.
Gallego-Bartolome et al., (2017). "Targeted DNA demethylation of the *Arabidopsis* genome using the human TET1 catalytic domain," PNAS, 115(9):e2125-e2134.
Guilinget et al., (2014). "Fusion of catalytically inactive Cas9 to FokI nuclease improves the specificity of genome modification," Nature Biotechnology, 32(6):577-582, 17 pages.
Guo et al., (2011). "Hydroxylation of 5-methylcytosine by TET1 promotes active DNA demethylation in the adult brain," Cell, 145(3):423-34.
Hashimoto et al., (2014). "Structure of a Naegleria Tet-like dioxygenase in complex with 5-methylcytosine DNA," Nature, 506(7488):391-5, 29 pages.
He et al., (2011). "Tet-Mediated Formation of 5-Carboxylcytosine and its Excision by TDG in Mammalian DNA," Science, 333:1303-1307, 10 pages.
Higgins et al., (1989). "Fast and sensitive multiple sequence alignments on a microcomputer," Cabios, 5:151-153.
Hollwey et al., (2016). "Expression of the C-Terminal Domain of Mammalian TET3 DNA Dioxygenase in *Arabidopsis thaliana* Induces Heritable Methylation Changes at rDNA Loci," Advances in Bioscience and Biotechnology, 7:243-50.
International Search Report and Written Opinion received for PCT Patent Application No. PCT/US2018/014741, dated May 11, 2018, 19 pages.
Ito et al., (2010), "Role of Tet proteins in 5mC to 5hmC conversion, ES-cell self-renewal and inner cell mass specification," Nature, 466(7310):1129-1133, 15 Pages.
Ito et al., (2011). "Tet proteins can convert 5-methylcytosine to 5-formylcytosine and 5-carboxylcytosine," Science, 333(6047):1300-3.
Jinek et al., (2012). "A Programmable Dual-RNA-Guided DNA Endonuclease in Adaptive Bacterial Immunity," Science, 337(6096):816-821.
Jinek et al., (2013). "RNA-programmed genome editing in human cells," eLife, 2:e00471, 9 pages.
Johannes et al., (2009). "Assessing the Impact of Transgenerational Epigenetic Variation on Complex Traits," PLoS Genetics, 5(6):e1000530, 11 pages.

Johnson et al., (2014). "Corrigendum: SRA-and SET-Domain-Containing Proteins link RNA Polymerase V Occupancy to DNA Methylation," Nature, 507:1 page.
Johnson et al., (2014). "SRA- and SET-domain-containing proteins link RNA polymerase V occupancy to DNA methylation," Nature, 507(7490):124-8.
Karlin et al., (1990). "Methods for assessing the statistical significance of molecular sequence features by using general scoring schemes," Proc. Natl. Acad. Sci. USA, 87:2264-2268.
Karlin et al., (1993). "Applications and Statistics for Multiple High-Scoring Segments in Molecular Sequences," Proc Natl Acad. Sci., 90:5873-5877.
Konermann et al., (2015). "Genome-scale transcriptional activation by an engineered CRISPR-CAS9 complex," Nature, 517:583.
Langridge et al., (1989). "Dual promoter of Agrobacterium tumefaciens mannopine synthase genes is regulated by plant growth hormones," PNAS USA, 86:3219-3223.
Last et al., (1991). "pEmu: an improved promoter for gene expression in cereal cells," Theor. Appl. Genet., 81:581-588.
Lei et al., (2015). "Regulatory link between DNA methylation and active demethylation in *Arabidopsis*," Proc Natl Acad Sci, 112(11):3553-3557.
Li et al., (2013). "Multiplex and homologous recombination-mediated plant genome editing via guide RNA/Cas9," Nature Biotechnology, 31:688-691, 8 pages.
Liu et al., (2016). "Editing DNA Methylation in the Mammalian Genome," Cell, 167(1):233-247.
Luque et al., (2000). "A Constitutive Region is Responsible for Nuclear Targeting of 4.1 R: Modulation by Alternative Sequences Results in Differential Intracellular Localization," Journal of Cell Science, 113:2485-2496.
Maeder et al., (2013). "Targeted DNA demethylation and activation of endogenous genes using programmable TALE-TET1 fusion proteins," Nat Biotechnol., 31(12):1137-42, 16 pages.
Mali et al., (2013). "CAS9 transcriptional activators for target specificity screening and paired nickases for cooperative genome engineering," Nature Biotechnology, 31:833-838, 17 pages.
Marton et al., (2010). "Nontransgenic Genome Modification in Plant Cells", Plant Physiology 154:1079-1087.
Matteucci et al., (1980). "The synthesis of oligodeoxyprimidines on a polymer support," Tetrahedron Lett, 21:719-722.
McCabe et al., (1988). "Stable Transformation of Soybean (*Glycini max*) by Particle Acceleration," Bio/Technology, 6:923-926.
McCormick et al., (1986). "Leaf Disc Transformation of Cultivated Tomato (*L. Esculentum*) using Agrobacterium Tumefaciens," Plant Cell Reports, 5:81-84.
McElroy et al., (1990). "Isolation of an efficient actin promoter for use in rice transformation," Plant Cell, 2:163-171.
Miller et al., (1985). "Repetitive zinc-binding domains in the protein transcription factor IIIA from Xenopus oocytes," EMBO Journal, 4(6):1609-1614.
Mitsunobu et al., (2017). "Beyond Native Cas9: Manipulating Genomic Information and Function," Trends in Biotechnology, 35(10):983-96.
Morita et al., (2016). "Targeted DNA demethylation in vivo using dCas9-peptide repeat and scFv-TET1 catalytic domain fusions," Nature Biotechnology, 34:1060-1065.
Murray et al., (1989). "Codon Usage in Plant Genes," Nucleic Acids Research, 17(2):477-498.
Myers et al., (1988). "Optimal alignments in linear space," Cabios 4:11-17.
Needleman et al., (1970). "A General Method Applicable to the Search for Similarities in the Amino Acid Sequence of Two Proteins," Journal of Molecular Biology, 48:443-453.
Odell et al., (1985). "Identification of DNA Sequences required for Activity of the Cauliflower Mosaic Virus 35S Promoter," Nature, 313:810-812.
Pastor et al., (2013). "TETonic shift: biological roles of TET proteins in DNA demethylation and transcription," Nature Rev Mol Cell Biol, 14(6): 341-356, 34 pages.
Paszkowski et al., (1984). "Direct Gene Transfer to Plants," The EMBO Journal, 3(12):2717-2722.

(56) References Cited

OTHER PUBLICATIONS

Pearson et al., (1988). "Improved Tools for Biological Sequence Comparison," Proc. Natl. Acad. Sci., 85:2444-2448.
Qi et al., (2013). "Repurposing CRISPR as an RNA-Guided Platform for Sequence-Specific Control of Gene Expression," Cell, 152:1173-1183.
Reiss et al., (1987). "Regions in the transit peptide of SSU essential for transport into chloroplasts," Mol. Gen. Genet., 209(1):116-121.
Riggs et al., (1986). "Stable transformation of tobacco by electroporation: evidence for plasmid concatenation," Proc. Natl. Acad Sci. USA, 83:5602-5606.
Rogers et al., (1987). "Improved Vectors for Plant Transformation: Expression Cassette Vectors and New Selectable Markers," Methods in Enzymology, 153:253-277.
Saitou et al., (1987). "The neighbor-joining method: a new method for reconstructing phylogenetic trees," Mol. Biol. & Evo., 4:406-425.
Schardl et al., (1987). "Design and Construction of a Versatile System for the Expression of Foreign Genes in Plants," Gene, 61:1-11.
Settles et al., (1998). "Old and new pathways of protein export in chloroplasts and bacteria," Trends Cell Biol, 12:494-501.
Smith et al., (1981). "Comparison of biosequences," Adv. Appl. Math., 2:482-489.
Tahiliani et al., (2009). "Conversion of 5-Methylcytosineto 5-Hydroxymethylcytosine in Mammalian DNA by MLL Partner TET1," Science, 324:930-935, 11 pages.
Tamura et al., (2007). "MEGA4: Molecular Evolutionary Genetics Analysis (MEGA) software version 4.0," Mol. Biol. & Evo., 24:1596-1599.
Tanenbaum et al., (2014). "A protein-tagging system for signal amplification in gene expression and fluorescence imaging," Cell, 159:635-646.
Thompson et al., (1994). "CLUSTAL W: improving the sensitivity of progressive multiple sequence alignment through sequence weighting, position-specific gap penalties and weight matrix choice," Nucleic Acids Res., 22: 4673-4680.
Trapnell et al., (2009). "TopHat: discovering splice junctions with RNA-Seq," Bioinformatics, 25:1105-1111.
Van Tunen et al., (1988). Cloning of the two chaicone flavanone isomerase genes from Petunia hybrida: coordinate, light-regulated and differential expression of flavonoid genes, EMBO Journal, 7(5):1257-1263.
Velten et al., (1984). "Isolation of a Dual Plant Promoter Fragment from the Ti Plasmid of Agrobacterium Tumefaciens," The EMBO Journal, 3(12):2723-2730.
Walker et al., (1987). "DNA Sequences required for Anaerobic Expression of the Maize Alcohol dehydrogenase 1 Gene," Proc. Natl. Acad. Sci., 84:6624-6628.
Wang et al., (1992). "Characterization of cis-Acting Elements Regulating Transcription from the Promoter of a Constitutively Active Rice Actin Gene," Molecular and Cellular Biology, 12(8):3399-3406.
Williams et al., (2015). "Methylation-Sensitive Expression of a DNA Demethylase Gene Serves as an Epigenetic Rheostat," PLoS Genet, 11(3):e1005142, 18 pages.
Xie et al., (2015). "Boosting CRISPR/Cas9 multiplex editing capability with the endogenous tRNA processing system," Proc Natl Acad Sci USA, 112(11):3570-5.
Xing et al., (2014). "A CRISPR/Cas9 toolkit for multiplex genome editing in plants," BMC Plant Biology, 14:327, 12 pages.
Xu et al., (2016). "A CRISPR-based approach for targeted DNA demethylation," Cell Discov., 2:16009.
Zalatan et al., (2015). "Engineering complex synthetic transcriptional programs with CRISPR RNA scaffolds," Cell, 160:339-350.

\* cited by examiner

FIG. 50A
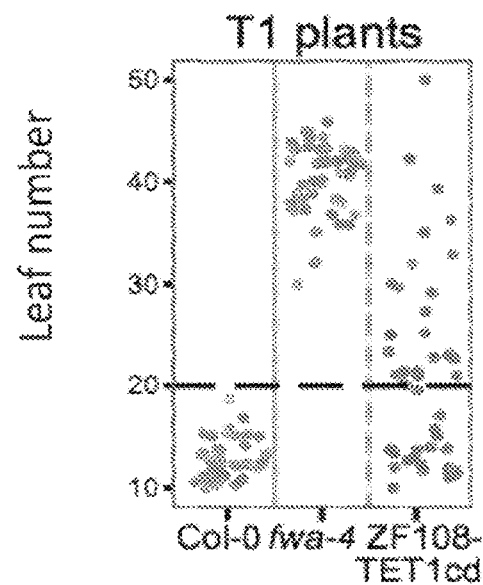
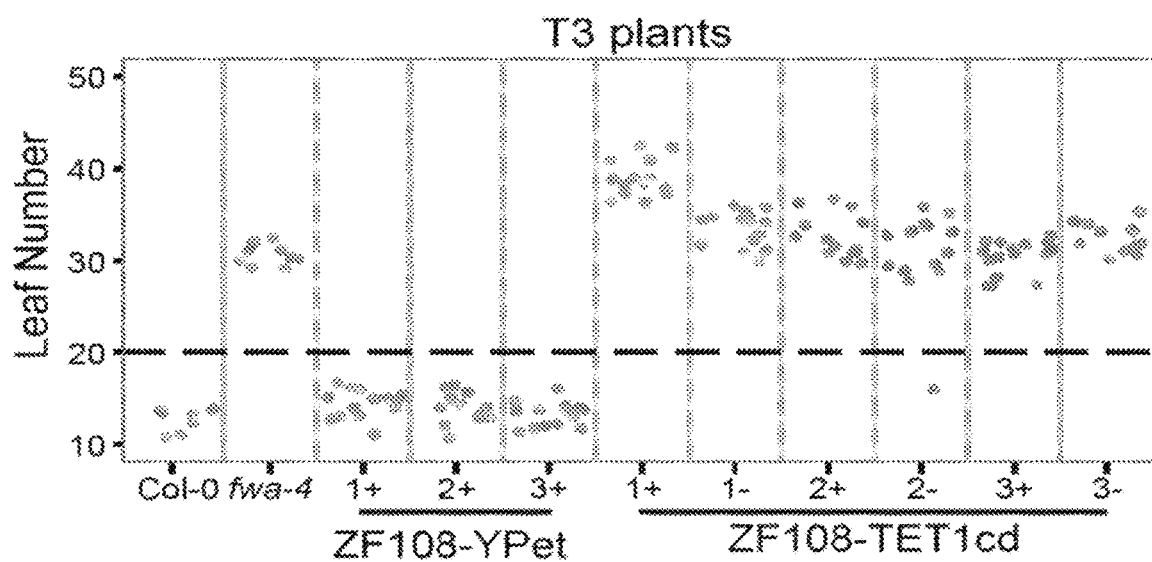
FIG. 50B

FIG. 51A
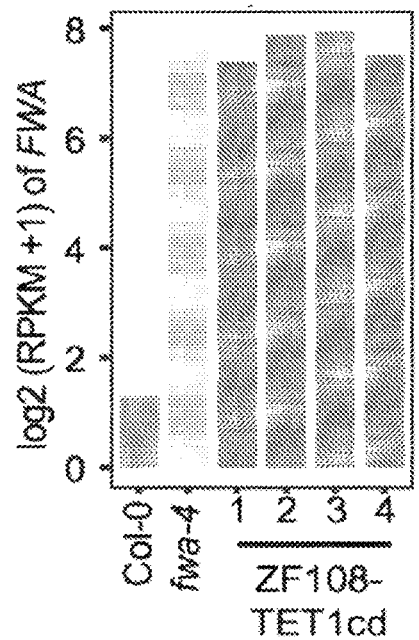
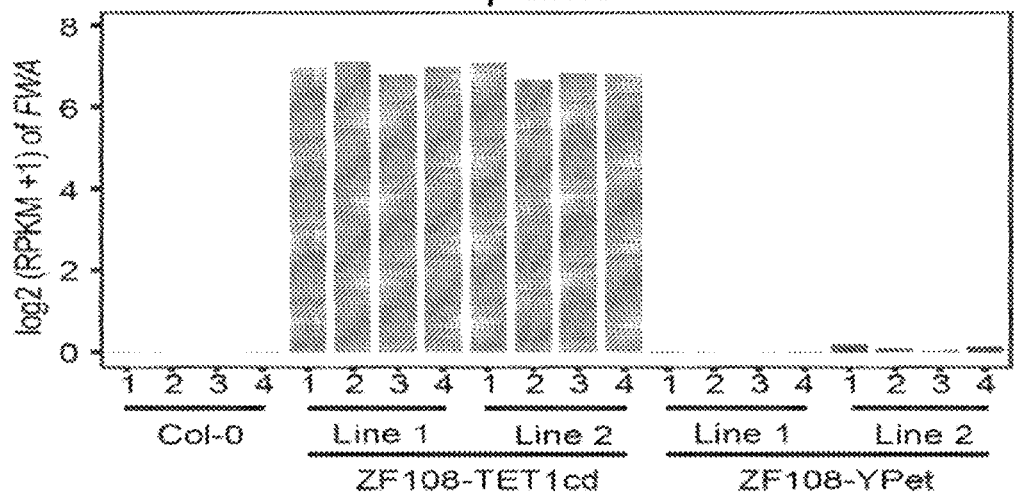
FIG. 51B

FIG. 66A

```
TET1    ELPTCSCLDRVIQKDKGPYYTHLGAGPSVAAVREIMENRYGQKGRAIRIEIVVYTGKEGK
TET2    EFISCRCVEQIEKDEGPPYTHLGAGPNVAAIREIMEERFGQKGRAIRIEKVIYTSKEGK
TET3    EFPTCRCVEQIVEKDEGPYYTHLSSGPTVASIRELMEERYGEKGEAIRIEKVIYTGKEGK
        ;:*;* *;:;;;;**;**;****;**,**;;**;**;*;;**;***** *;*******

TET1    SSRGCPIAKWVLPESSDEKVLCLVRQRIGHRCPTAVMVVLIDVWDGIPLPMADRLYTEL
TET2    SDQGCPIAKWVPRSSSEEKLLCLVREPAGHTCEAAVIVILIDVWEGIPLSLADKLYSEL
TET3    SSRGCPIAKWVIRHTLEEKLICLVRRAGHEQNAVIVILILAWDGIPRSLGUTLYQEL
        *  *********  ;  ***;****;*** *    **;;**;,**** ;;*  ** **

TET1    TENLKSYNGNFTDRRCTLNERRTCPCQGLDPETCGASFSPGCSWSMYFNGCKFGRSPSFR
TET2    TETLRKY-GFLTNRPCALNEERTCACQGLDPETCGASFSPGCSWSMYYNGCKFARSKIPR
TET3    TDTLRKY-GNPTSRRCGLRDPRTCACQGKDPNTCGASFSPGCSWGMYFNGCNYARSKIER
        * ;,*;,* *   *,***  **;;***,*** **;*********;****;,** **

TET1    RFRIDPSSPLHEK
TET2    KFKLLGDDPKEEE
TET3    KFRLAGDNPKEEE
        ;**;  ,,* ,*;

Percent Identity Matrix - created by Clustal2.1

1: TET1      100.00    69.37    66.15
            2: TET2       69.37   100.00    78.65
            3: TET3       66.15    78.65   100.00
```

TARGETED GENE DEMETHYLATION IN PLANTS

CROSS-REFERENCE TO RELATED APPLICATIONS

This application is a U.S. National Phase patent application under 35 U.S.C. § 371 of International Application No. PCT/US2018/014741, filed Jan. 22, 2018, which claims the benefit of U.S. Provisional Application No. 62/450,929, filed on Jan. 26, 2017, and U.S. Provisional Application No. 62/547,053, filed on Aug. 17, 2017, the disclosures of each of which are incorporated herein by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 262232001300SUBSEQLIST.TXT, date recorded: Feb. 4, 2020, size: 791 KB).

FIELD

The present disclosure relates to the use of recombinant proteins for inducing epigenetic modifications at specific loci, as well as to methods of using these recombinant proteins for modulating the expression of genes in plants.

BACKGROUND

Epigenetic marks are enzyme-mediated chemical modifications of DNA and of its associated chromatin proteins. Although epigenetic marks do not alter the primary sequence of DNA, they do contain heritable information and play key roles in regulating genome function. Such modifications, including cytosine methylation, posttranslational modifications of histone tails and the histone core, and the positioning of nucleosomes (histone octamers wrapped with DNA), influence the transcriptional state and other functional aspects of chromatin. For example, methylation of DNA and certain residues on the histone H3 N-terminal tail, such as H3 lysine 9 (H3K9), are important for transcriptional gene silencing and the formation of heterochromatin.

Different pathways involved in epigenetic gene expression regulation have been previously described, and include histone deacetylation, H3K27 and H3K9 methylation, H3K4 demethylation, and DNA methylation of promoters. In plants, proteins generally do not link the recognition of a specific DNA sequence with the establishment of an epigenetic state. Thus, endogenous plant epigenetic regulators generally cannot be used for epigenetic modifications of specific genes or transgenes in plants. However, the ability to specifically induce epigenetic modifications at a target locus is desirable as this may allow for controlled expression of the locus (e.g. control over gene expression). Moreover, there is currently no robust method for selectively demethylating and activating the expression of plant genes.

Accordingly, a need exists for epigenetic regulators that are capable of being targeted to specific loci to induce epigenetic modifications at those loci in plants.

BRIEF SUMMARY

In one aspect, the present disclosure relates to a method for reducing methylation of a target nucleic acid in a plant, including: (a) providing a plant including a recombinant polypeptide including a DNA-binding domain and a TET1 polypeptide or fragment thereof; and (b) growing the plant under conditions whereby the recombinant polypeptide is targeted to the target nucleic acid, thereby reducing methylation of the target nucleic acid. In some embodiments, the DNA-binding domain includes a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from the group of a Cys2His2 (C2H2) zinc finger domain, a CCCH zinc finger domain, a multi-cysteine zinc finger domain, and a zinc binuclear cluster domain. In some embodiments, the DNA-binding domain is selected from the group of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments, the DNA-binding domain includes a TAL effector targeting domain. In some embodiments, the DNA-binding domain includes three C2H2 zinc finger domains. In some embodiments that may be combined with any of the preceding embodiments, the TET1 polypeptide includes an amino acid sequence that is at least 80% identical to SEQ ID NO: 8. In some embodiments that may be combined with any of the preceding embodiments, the target nucleic acid is an endogenous nucleic acid. In some embodiments that may be combined with any of the preceding embodiments, the target nucleic acid is a heterologous nucleic acid. In some embodiments that may be combined with any of the preceding embodiments, expression of the target nucleic acid is activated as compared to a corresponding control nucleic acid.

In another aspect, the present disclosure provides a recombinant nucleic acid including a plant promoter and which encodes a recombinant polypeptide including a DNA-binding domain and a TET1 polypeptide or fragment thereof. The present disclosure further relates to expression vectors including the recombinant nucleic acid of the preceding embodiment, and a host cell including the expression vector of the preceding embodiment. The present disclosure also relates to a recombinant plant including the recombinant nucleic acid and/or polypeptide of the preceding embodiments.

In another aspect, the present disclosure provides a plant having reduced methylation of a target nucleic acid as a consequence of the method of any one of the preceding embodiments, as well as a progeny plant of the plant of the preceding embodiment. In some embodiments, the progeny plant has reduced methylation of the target nucleic acid and does not include the recombinant nucleic acid and/or polypeptide.

In another aspect, the present disclosure provides a method for reducing methylation of a target nucleic acid in a plant, including: (a) providing a plant including a recombinant polypeptide including a nuclease-deficient CAS9 polypeptide (dCAS9) or fragment thereof and a TET1 polypeptide or fragment thereof; and a crRNA and a tracrRNA, or fusions thereof, and (b) growing the plant under conditions whereby the recombinant polypeptide is targeted to the target nucleic acid, thereby reducing methylation of the target nucleic acid. In some embodiments, the TET1 polypeptide includes an amino acid sequence that is at least 80% identical to SEQ ID NO: 8. In some embodiments that may be combined with any of the preceding embodiments, the target nucleic acid is an endogenous nucleic acid. In some embodiments that may be combined with any of the preceding embodiments, the target nucleic acid is a heterologous nucleic acid. In some embodiments that may be combined with any of the preceding embodiments, expression of the target nucleic acid is activated as compared to a corresponding control nucleic acid.

In another aspect, the present disclosure provides a recombinant nucleic acid including a plant promoter and which encodes a recombinant polypeptide including a nuclease-deficient CAS9 polypeptide (dCAS9) or fragment thereof and a TET1 polypeptide or fragment thereof. The present disclosure further relates to expression vectors including the recombinant nucleic acid of the preceding embodiment, and a host cell including the expression vector of the preceding embodiment. The present disclosure also relates to a recombinant plant including the recombinant nucleic acid and/or polypeptide of the preceding embodiments.

In another aspect, the present disclosure provides a plant having reduced methylation of a target nucleic acid as a consequence of the method of any one of the preceding embodiments, as well as a progeny plant of the plant of the preceding embodiment. In some embodiments, the progeny plant has reduced methylation of the target nucleic acid and does not include the recombinant nucleic acid and/or polypeptide.

In another aspect, the present disclosure provides a method for reducing methylation of a target nucleic acid in a plant, the method including: (a) providing a plant including a recombinant TET1-like polypeptide or fragment thereof; and (b) growing the plant under conditions whereby the recombinant polypeptide is targeted to the target nucleic acid, thereby reducing methylation of the target nucleic acid.

In another aspect, the present disclosure provides a method for reducing methylation of a target nucleic acid in a plant, the method including: (a) providing a plant including a recombinant nucleic acid encoding a TET1-like protein or fragment thereof; and (b) growing the plant under conditions where the recombinant nucleic acid is expressed and where the recombinant polypeptide is targeted to the one or more target nucleic acids, thereby reducing methylation of the target nucleic acid.

In another aspect, the present disclosure provides a method for reducing methylation of a target nucleic acid in a plant, the method including: (a) providing a plant including a recombinant nucleic acid encoding a TET1-like protein or fragment thereof; and a crRNA and tracrRNA, or fusions thereof, and where the plant expresses a dCAS9 protein; and (b) growing the plant under conditions where the recombinant nucleic acid is expressed and where the recombinant polypeptide is targeted to the one or more target nucleic acids, thereby reducing methylation of the target nucleic acid. In some embodiments, the recombinant polypeptide includes a dCAS9 protein or fragment thereof. In some embodiments, the recombinant polypeptide includes an MS2 protein or fragment thereof. In some embodiments, the recombinant polypeptide includes an scFV antibody or fragment thereof.

In another aspect, the present disclosure provides a method for reducing methylation of a target nucleic acid in a plant, including: (a) providing a plant including: a first recombinant polypeptide including a nuclease-deficient CAS9 polypeptide (dCAS9) or fragment thereof and a multimerized epitope; a second recombinant polypeptide including a TET1 polypeptide or fragment thereof and an affinity polypeptide that specifically binds to the epitope; a crRNA and a tracrRNA, or fusions thereof; and (b) growing the plant under conditions whereby the first and second recombinant polypeptides are targeted to the one or more target nucleic acids, thereby reducing methylation of the target nucleic acid. In some embodiments, the dCAS9 polypeptide has an amino acid sequence that is at least 80% identical, at least 85% identical, at least 90% identical, at least 95% identical, or 100% identical to SEQ ID NO: 125. In some embodiments that may be combined with any of the preceding embodiments, the multimerized epitope includes a GCN4 epitope. In some embodiments, the multimerized epitope includes about 2 to about 10 copies of a GCN4 epitope. In some embodiments that may be combined with any of the preceding embodiments, the first polypeptide includes one or more linkers that link polypeptide units in the recombinant polypeptide. In some embodiments that may be combined with any of the preceding embodiments, the first polypeptide includes a nuclear localization signal (NLS). In some embodiments that may be combined with any of the preceding embodiments, the TET1 polypeptide includes an amino acid sequence that is at least 80% identical to SEQ ID NO: 8. In some embodiments that may be combined with any of the preceding embodiments, the affinity polypeptide is an antibody. In some embodiments, the antibody is an scFv antibody. In some embodiments, the antibody includes an amino acid sequence that is at least 80% identical to SEQ ID NO: 132. In some embodiments that may be combined with any of the preceding embodiments, the second polypeptide includes one or more linkers that link polypeptide units in the recombinant polypeptide. In some embodiments that may be combined with any of the preceding embodiments, the crRNA and the tracrRNA are fused together, thereby forming a guide RNA (gRNA). In some embodiments that may be combined with any of the preceding embodiments, expression of the nucleic acid is increased in the range of about 2-fold to about 100-fold as compared to a corresponding control. In some embodiments that may be combined with any of the preceding embodiments, expression of the nucleic acid is decreased in the range of about 2-fold to about 100-fold as compared to a corresponding control.

In another aspect, the present disclosure provides a recombinant vector including: a first nucleic acid sequence including a plant promoter and that encodes a recombinant polypeptide including a nuclease-deficient CAS9 polypeptide (dCAS9) or fragment thereof and a multimerized epitope; a second nucleic acid sequence including a plant promoter and that encodes a recombinant polypeptide including a TET1 polypeptide or fragment thereof and an affinity polypeptide that specifically binds to the epitope; and a third nucleic acid sequence including a promoter and that encodes a crRNA and a tracrRNA, or fusions thereof.

Also provided are host cells including the vector or one or more of the recombinant polypeptides or nucleic acids of any of the preceding embodiments, and a recombinant plant including the vector or one or more of the recombinant polypeptides or nucleic acids of any of the preceding embodiments.

In another aspect, the present disclosure provides a plant having reduced methylation of a target nucleic acid as a consequence of the method of any of the preceding embodiments. Also provided is a progeny plant of the plant of the preceding embodiment. In some embodiments, the progeny plant has reduced methylation of the target nucleic acid and does not include the recombinant polypeptides.

In another aspect, the present disclosure provides a method for reducing methylation of a target nucleic acid in a plant, including: (a) providing a plant including a recombinant polypeptide including a DNA-binding domain and a methylcytosine dioxygenase polypeptide that includes the amino acid sequence of SEQ ID NO: 189; and (b) growing the plant under conditions whereby the recombinant polypeptide is targeted to the target nucleic acid, thereby reducing methylation of the target nucleic acid. In some embodiments, the DNA-binding domain comprises a zinc finger domain. In some embodiments, the zinc finger domain includes two, three, four, five, six, seven, eight, or nine zinc fingers. In some embodiments, the zinc finger domain is a zinc finger array. In some embodiments, the zinc finger domain is selected from the group consisting of a Cys2His2 (C2H2) zinc finger domain, a CCCH zinc finger domain, a multi-cysteine zinc finger domain, and a zinc binuclear cluster domain. In some embodiments, the DNA-binding domain is selected from the group consisting of a TAL effector targeting domain, a helix-turn-helix family DNA-binding domain, a basic domain, a ribbon-helix-helix domain, a TBP domain, a barrel dimer domain, a real homology domain, a BAH domain, a SANT domain, a Chromodomain, a Tudor domain, a Bromodomain, a PHD domain, a WD40 domain, and a MBD domain. In some embodiments, the DNA-binding domain includes a TAL effector targeting domain. In some embodiments, the DNA-binding domain includes three C2H2 zinc finger domains. In some embodiments that may be combined with any of the preceding embodiments, the methylcytosine dioxygenase polypeptide is a TET polypeptide. In some embodiments, the TET polypeptide is a TET1 polypeptide. In some embodiments, the TET1 polypeptide includes the catalytic domain of TET1. In some embodiments, the TET1 polypeptide includes an amino acid sequence that is at least 80% identical to SEQ ID NO: 8. In some embodiments that may be combined with any of the preceding embodiments, the target nucleic acid is an endogenous nucleic acid. In some embodiments that may be combined with any of the preceding embodiments, the target nucleic acid is a heterologous nucleic acid. In some embodiments that may be combined with any of the preceding embodiments, expression of the target nucleic acid is activated as compared to a corresponding control nucleic acid.

In another aspect, the present disclosure provides a recombinant nucleic acid including a plant promoter and which encodes a recombinant polypeptide including a DNA-binding domain and a methylcytosine dioxygenase polypeptide that includes the amino acid sequence of SEQ ID NO: 189.

In another aspect, the present disclosure provides a method for reducing methylation of a target nucleic acid in a plant, including: (a) providing a plant including: a first recombinant polypeptide including a nuclease-deficient CAS9 polypeptide (dCAS9) or fragment thereof and a multimerized epitope; a second recombinant polypeptide including a methylcytosine dioxygenase polypeptide that includes the amino acid sequence of SEQ ID NO: 189, and an affinity polypeptide that specifically binds to the epitope; and a crRNA and a tracrRNA, or fusions thereof; and (b) growing the plant under conditions whereby the first and second recombinant polypeptides are targeted to the one or more target nucleic acids, thereby reducing methylation of the target nucleic acid. In some embodiments, the dCAS9 polypeptide has an amino acid sequence that is at least 80% identical, at least 85% identical, at least 90% identical, at least 95% identical, or 100% identical to SEQ ID NO: 125.

In some embodiments that may be combined with any of the preceding embodiments, the multimerized epitope includes a GCN4 epitope. In some embodiments, the multimerized epitope includes about 2 to about 10 copies of a GCN4 epitope. In some embodiments that may be combined with any of the preceding embodiments, the first polypeptide includes one or more linkers that link polypeptide units in the recombinant polypeptide. In some embodiments that may be combined with any of the preceding embodiments, the first polypeptide includes a nuclear localization signal (NLS). In some embodiments that may be combined with any of the preceding embodiments, the methylcytosine dioxygenase polypeptide is a TET polypeptide. In some embodiments, the TET polypeptide is a TET1 polypeptide. In some embodiments, the TET1 polypeptide includes the catalytic domain of TET1. In some embodiments, the TET1 polypeptide includes an amino acid sequence that is at least 80% identical to SEQ ID NO: 8. In some embodiments that may be combined with any of the preceding embodiments, the affinity polypeptide is an antibody. In some embodiments, the antibody is an scFv antibody. In some embodiments, the antibody includes an amino acid sequence that is at least 80% identical to SEQ ID NO: 132. In some embodiments that may be combined with any of the preceding embodiments, the second polypeptide includes one or more linkers that link polypeptide units in the recombinant polypeptide. In some embodiments that may be combined with any of the preceding embodiments, the crRNA and the tracrRNA are fused together, thereby forming a guide RNA (gRNA). In some embodiments that may be combined with any of the preceding embodiments, expression of the nucleic acid is increased in the range of about 2-fold to about 100-fold as compared to a corresponding control. In some embodiments that may be combined with any of the preceding embodiments, expression of the nucleic acid is decreased in the range of about 2-fold to about 100-fold as compared to a corresponding control.

In another aspect, the present disclosure provides a recombinant vector including: a first nucleic acid sequence including a plant promoter and that encodes a recombinant polypeptide including a nuclease-deficient CAS9 polypeptide (dCAS9) or fragment thereof and a multimerized epitope; a second nucleic acid sequence including a plant promoter and that encodes a recombinant polypeptide including a methylcytosine dioxygenase polypeptide that includes the amino acid sequence of SEQ ID NO: 189, and an affinity polypeptide that specifically binds to the epitope; and a third nucleic acid sequence including a promoter and that encodes a crRNA and a tracrRNA, or fusions thereof.

Also provided are host cells including the vector or one or more of the recombinant polypeptides or nucleic acids of any of the preceding embodiments, and a recombinant plant including the vector or one or more of the recombinant polypeptides or nucleic acids of any of the preceding embodiments.

In another aspect, the present disclosure provides a plant having reduced methylation of a target nucleic acid as a consequence of the method of any of the preceding embodiments. Also provided is a progeny plant of the plant of the preceding embodiment. In some embodiments, the progeny plant has reduced methylation of the target nucleic acid and does not include the recombinant polypeptides.

DESCRIPTION OF THE FIGURES

FIG. 50A-FIG. 50B illustrate flowering time data. FIG. 50A illustrates the flowering time of Col-0, fwa-4, and a population of T1 plants with ZF108-TET1cd. FIG. 50B illustrates the flowering time data of Col-0, fwa-4, T3 plants from 3 independent lines containing pUBQ10_ZF108_3xFlag_YPet and T3 plants from 3 independent lines that have either retained the pUBQ10::ZF108_3xFlag_TET1-CD transgene (+) or plants where the pUBQ10::ZF108_3xFlag_TET1-CD transgene was segregated away (−).

FIG. 51A-FIG. 51B illustrate RNA-seq analysis data. FIG. 51A illustrates RNA-seq data of one wild-type Col-0 plant, an fwa-4 plant, and four independent T1 plants expressing the pUBQ10::ZF108_3xFlag_TET1-CD transgene with a bar graph of RPKM values (RPKM+1). FIG. 51B illustrates RNA-seq data of four replicates of Col-0 wild-type plants, four replicates from T3 plants from two independent lines containing pUBQ10::ZF108_3xFlag_YPet, and four replicates from T3 plants from two independent lines containing the pUBQ10::ZF108_3xFlag_TET1-CD transgene in a bar graph of RPKM values (RPKM+1).

Figure 52:
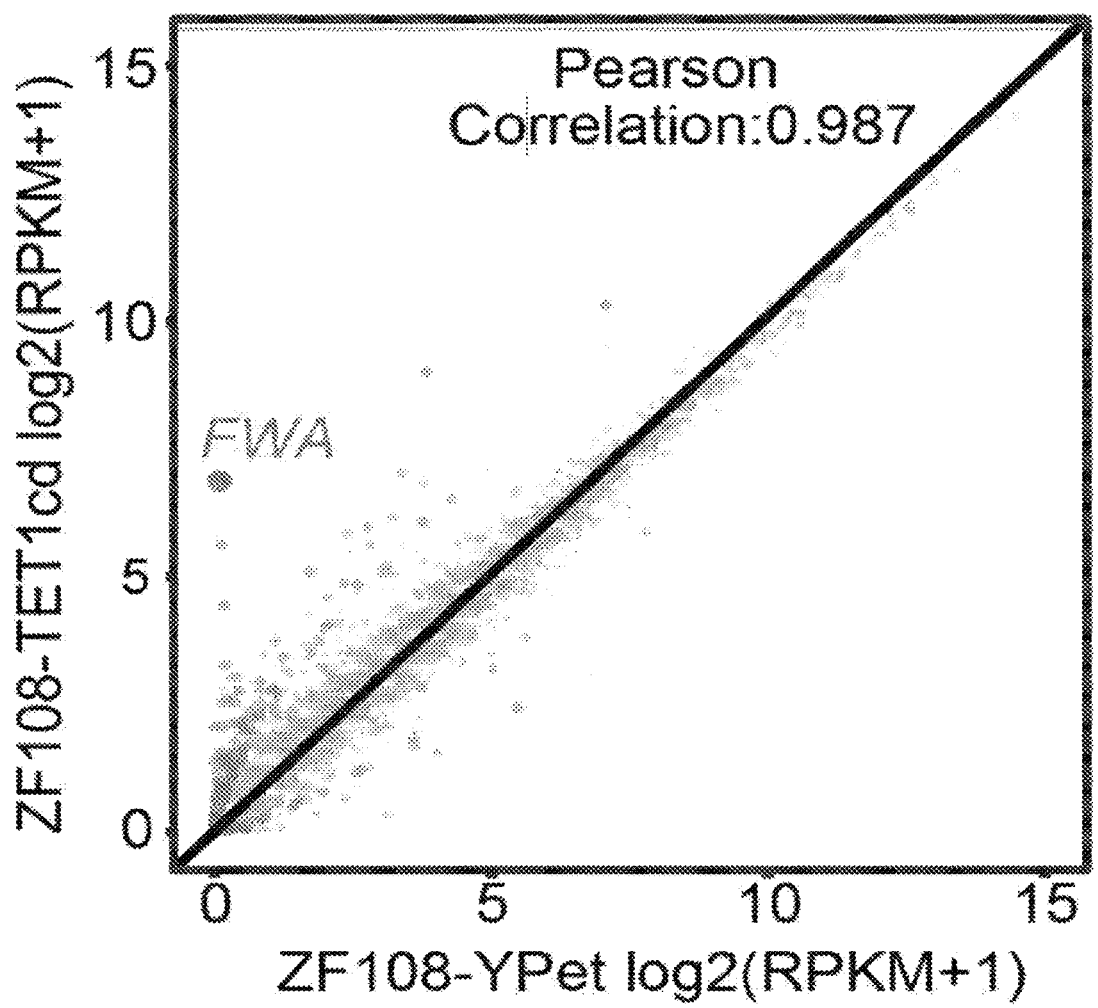

FIG. 52 illustrates a scatterplot of RNA-seq data comparing gene expression of ZF108-TET1cd lines and ZF108-YPet lines. Values were calculated using four biological replicates of two independent lines for ZF108-TET1cd and ZF108-YPet. Gray dots indicate non-differentially expressed genes. Blue dots indicate differentially expressed genes. A 4-fold change and FDR less than 0.05 was used as a cutoff. FWA expression is highlighted in red.

Figure 53:
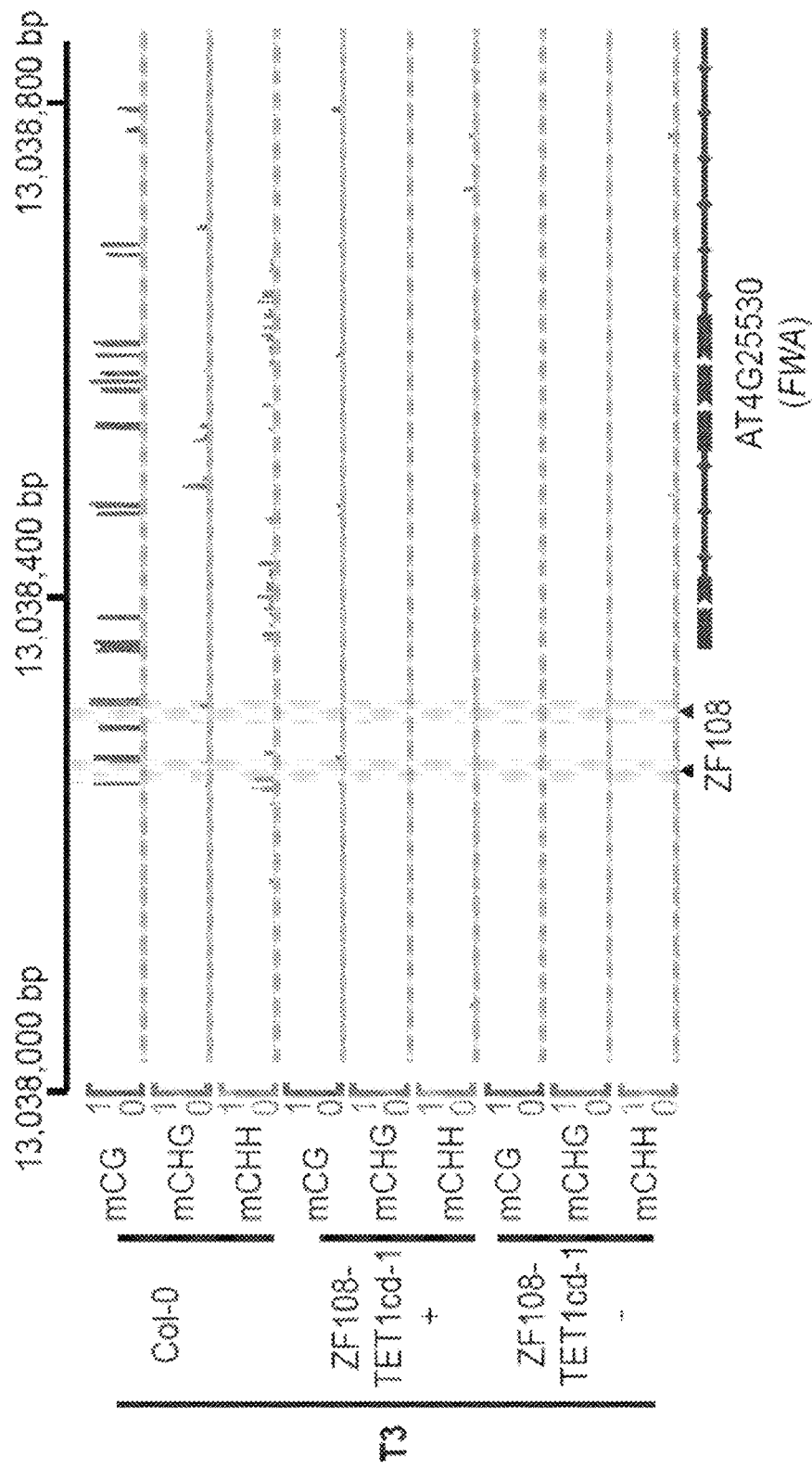

FIG. 53 illustrates Whole Genome Bisulfite Sequencing results. DNA methylation levels of one wild-type Col-0 plant and late flowering T3 transgenic line that have either retained the pUBQ10::ZF108_3xFlag_TET1-CD transgene (+) or where the transgene had been segregated away (−) were analyzed by BS-seq. Methylation levels at different contexts (CG, CHG and CHH, where H is C, T, or A) are shown. The black triangles indicate the ZF108 binding sites in the promoter region of FWA.

Figure 54:
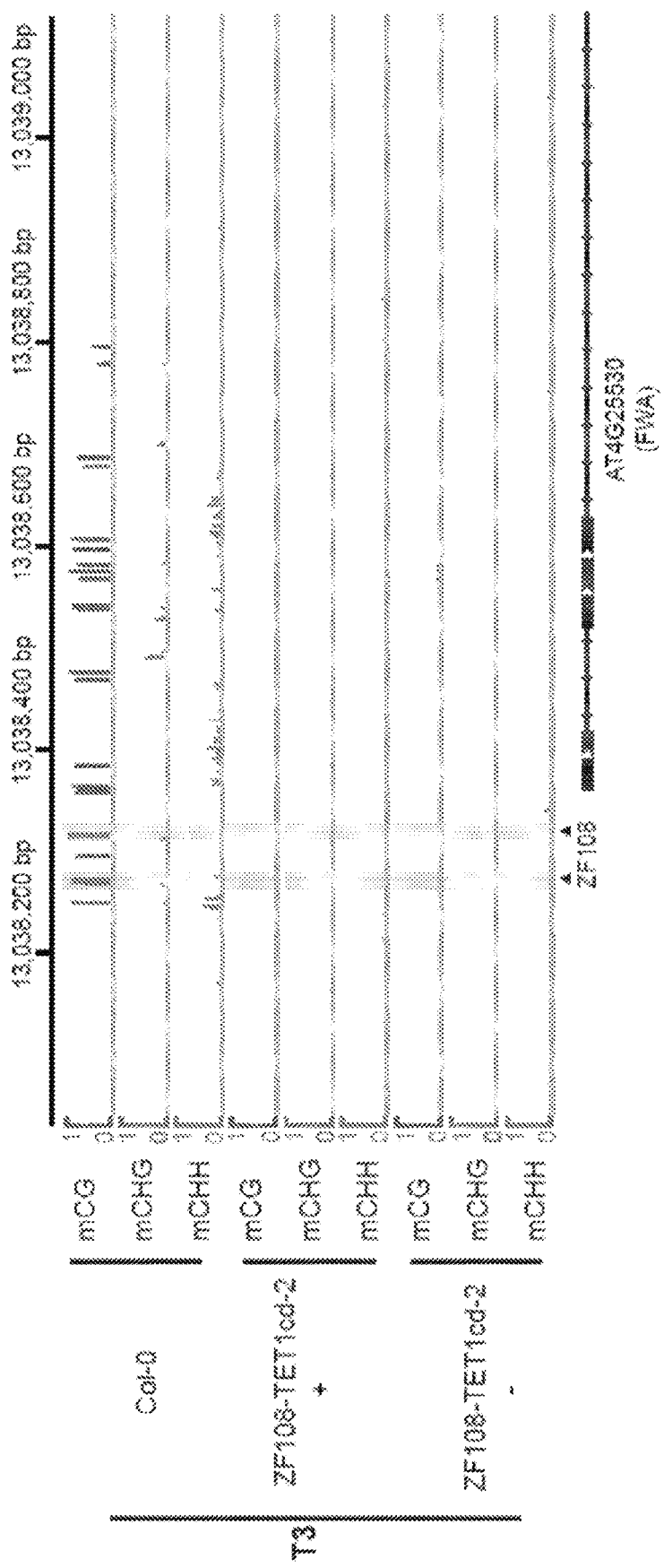

FIG. 54 illustrates Whole Genome Bisulfite Sequencing results. DNA methylation levels of one wild-type Col-0 plant and late flowering T3 transgenic lines that have either retained the pUBQ10::ZF108_3xFlag_TET1-CD transgene (+) or where the transgene had been segregated away (−) were analyzed by BS-seq. Methylation levels of different contexts (CG, CHG and CHH, where H is C, T, or A) are shown for a wild-type Col-0 plant and plants that have either retained the pUBQ10::ZF108_3xFlag_TET1-CD transgene or where the transgene had been segregated away. The black triangles indicate the ZF108 binding sites in the promoter region of FWA.

Figure 55:
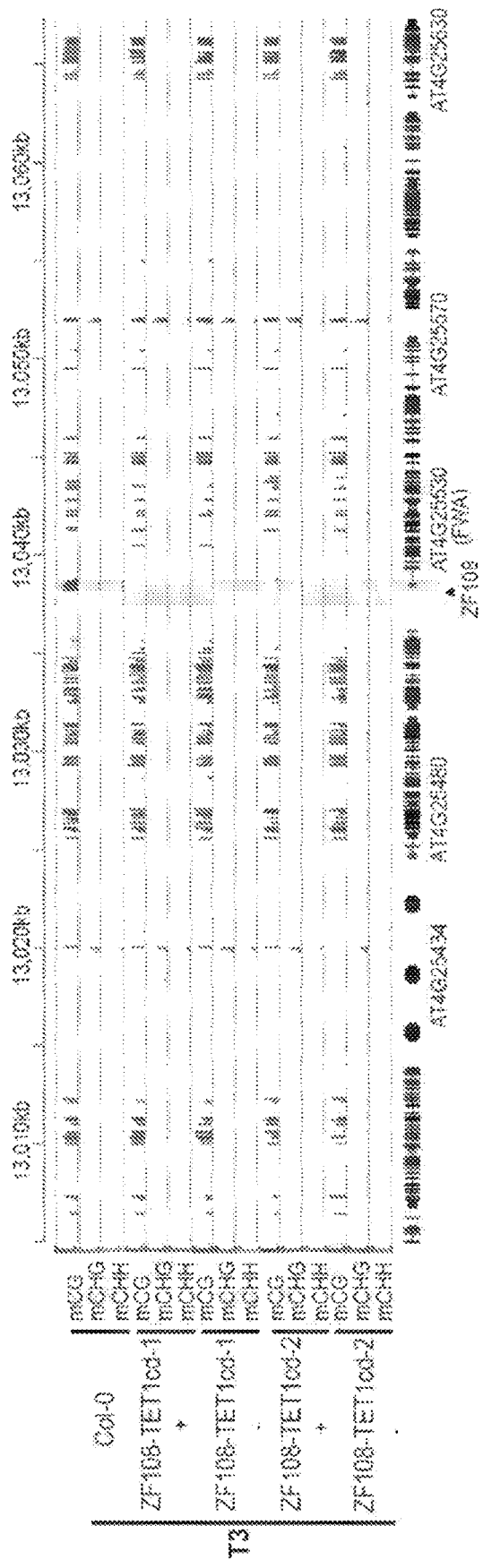

FIG. 55 illustrates a zoomed-out view of the Whole Genome Bisulfite Sequencing results presented in FIG. 53 and FIG. 54. DNA methylation levels of one wild-type Col-0 plant and two late flowering T3 transgenic lines that have either retained the pUBQ10::ZF108_3xFlag_TET1-CD transgene (+) or where the transgene had been segregated away (−) were analyzed by BS-seq. Methylation levels at different contexts (CG, CHG and CHH, where H is C, T, or A) are shown. The blue triangle indicates the ZF108 binding sites in the promoter region of FWA.

Figure 56:
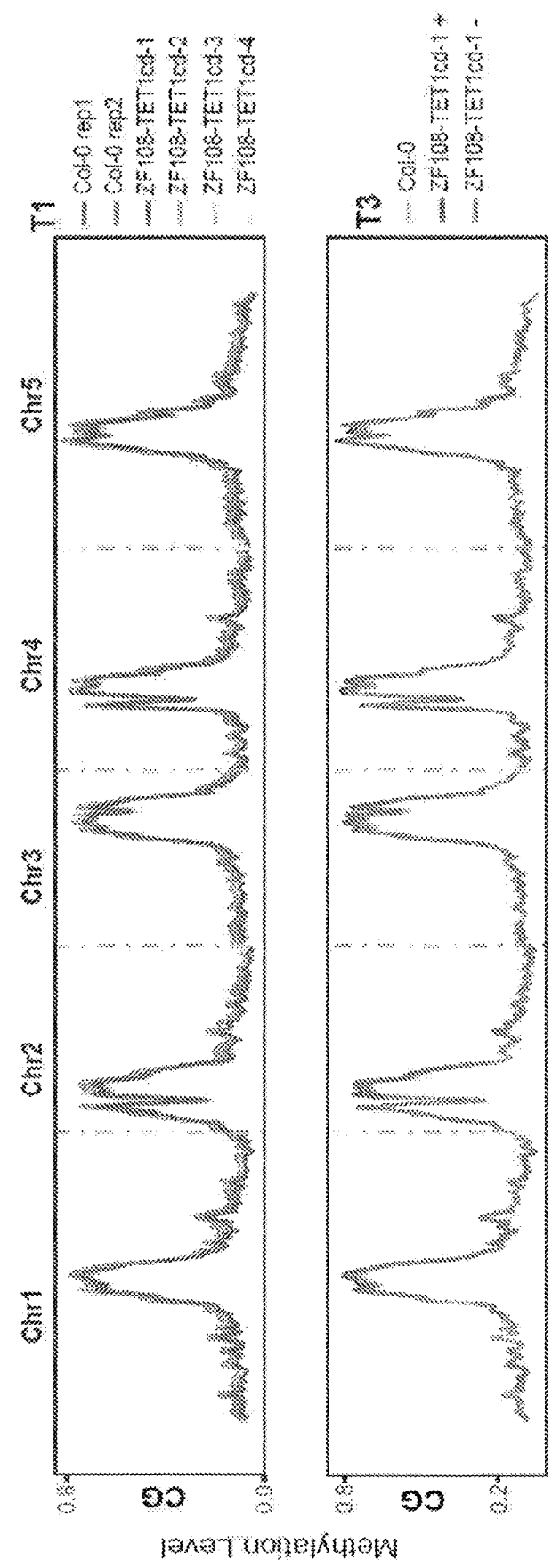

FIG. 56 illustrates the genome-wide CG methylation levels in Col-0 plants, four independent T1 plants containing the pUBQ10::ZF108_3xFlag_TET1-CD transgene, a T3 plant that retained the pUBQ10::ZF108_3xFlag_TET1-CD transgene (+) and a T3 plant that has had the transgene segregated away (−). Percent methylation is depicted on the Y-axis.

Figure 57:
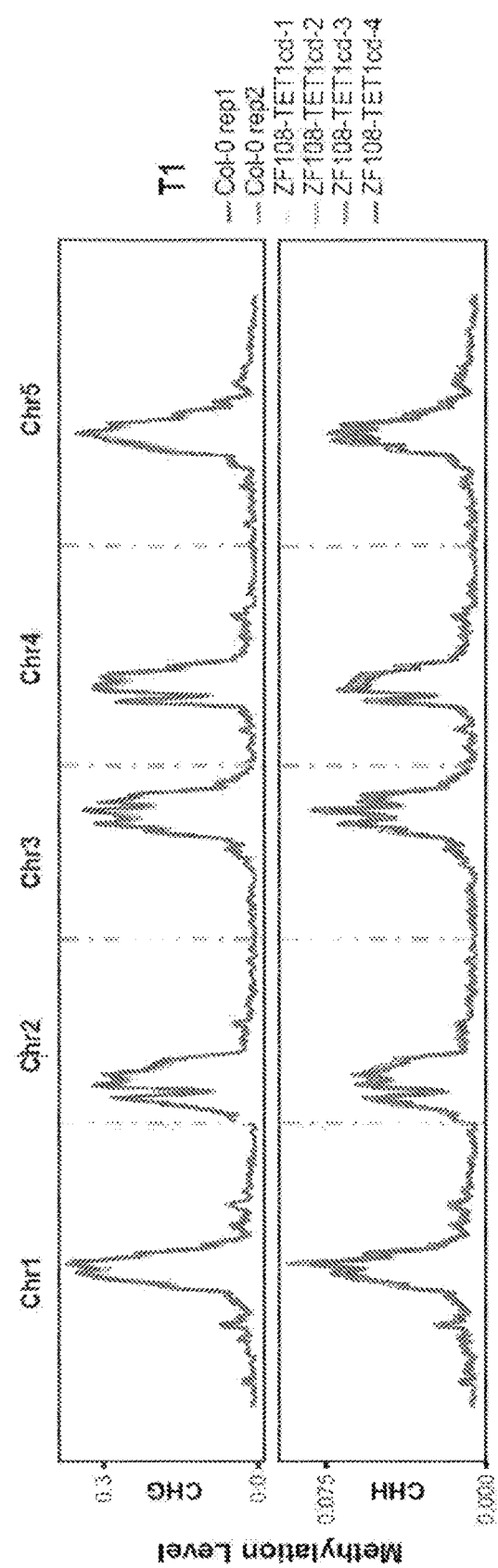

FIG. 57 illustrates the genome-wide CHG and CHH methylation levels in Col-0 plants and four independent T1 plants containing the pUBQ10::ZF108_3xFlag_TET1-CD transgene. Percent methylation is depicted on the Y-axis.

Figure 58:
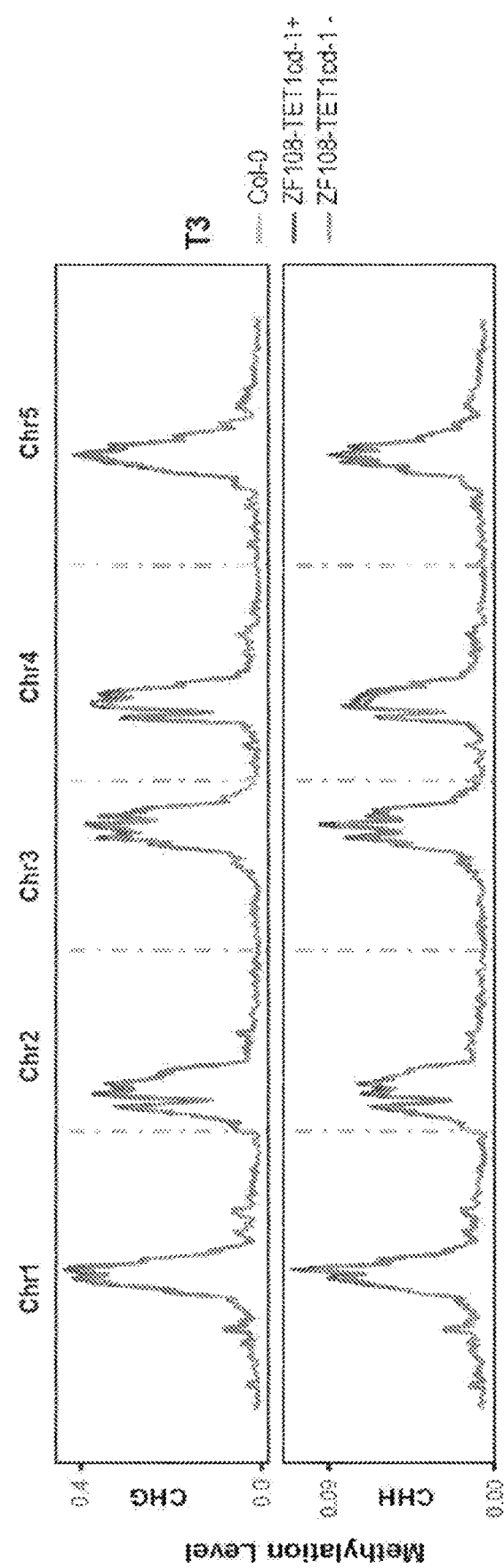

FIG. 58 illustrates the genome-wide CHG and CHH methylation levels in one wild-type Col-0 plant, a T3 plant that retained the pUBQ10::ZF108_3xFlag_TET1-CD transgene (+) and a T3 plant that has had the transgene segregated away (−). Percent methylation is depicted on the Y-axis.

Figure 59:
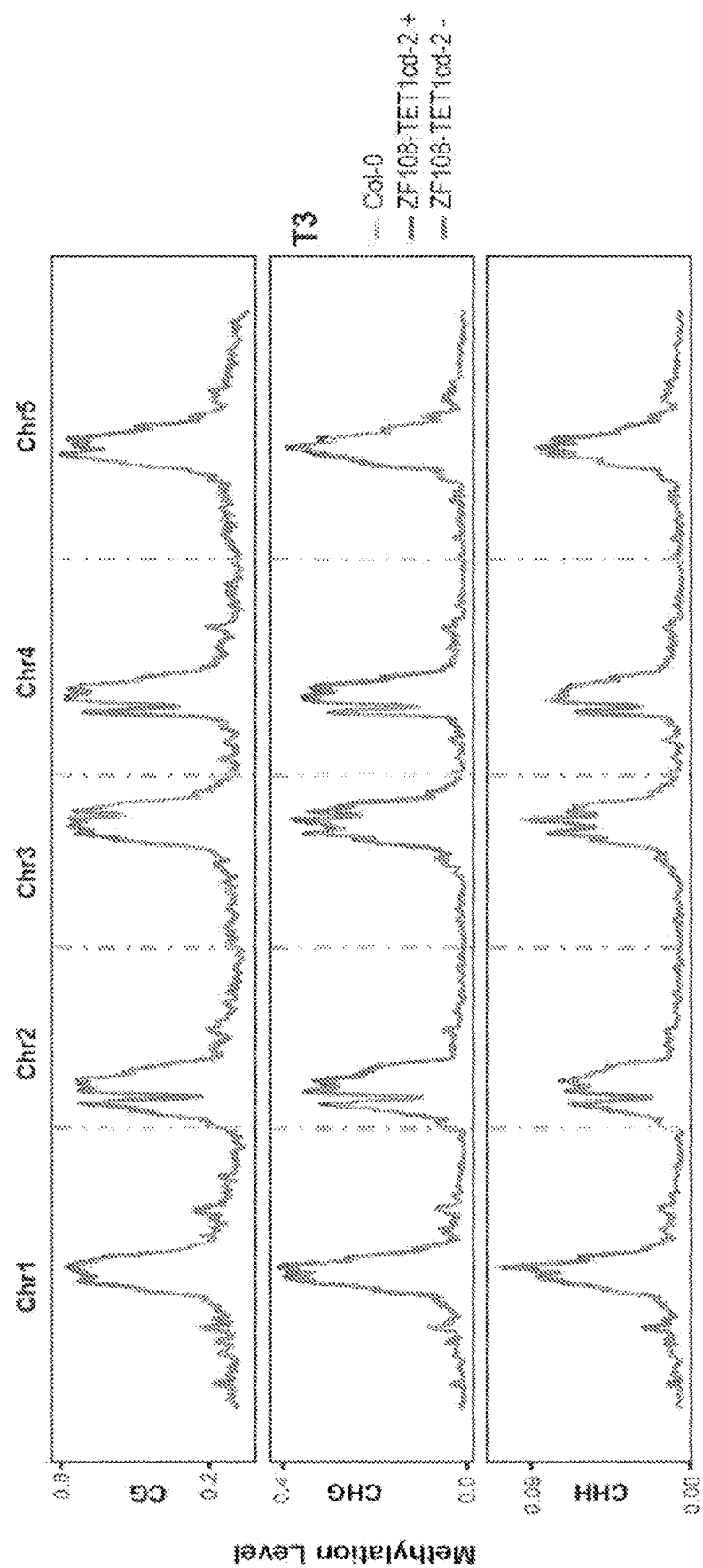

FIG. 59 illustrates the genome-wide CG, CHG and CHH methylation levels in one wild-type Col-0 plant and a plant that retained the pUBQ10::ZF108_3xFlag_TET1-CD transgene (+) and a T3 plant that has had the transgene segregated away (−) from another T3 line. Percent methylation is depicted on the Y-axis.

Figure 60:
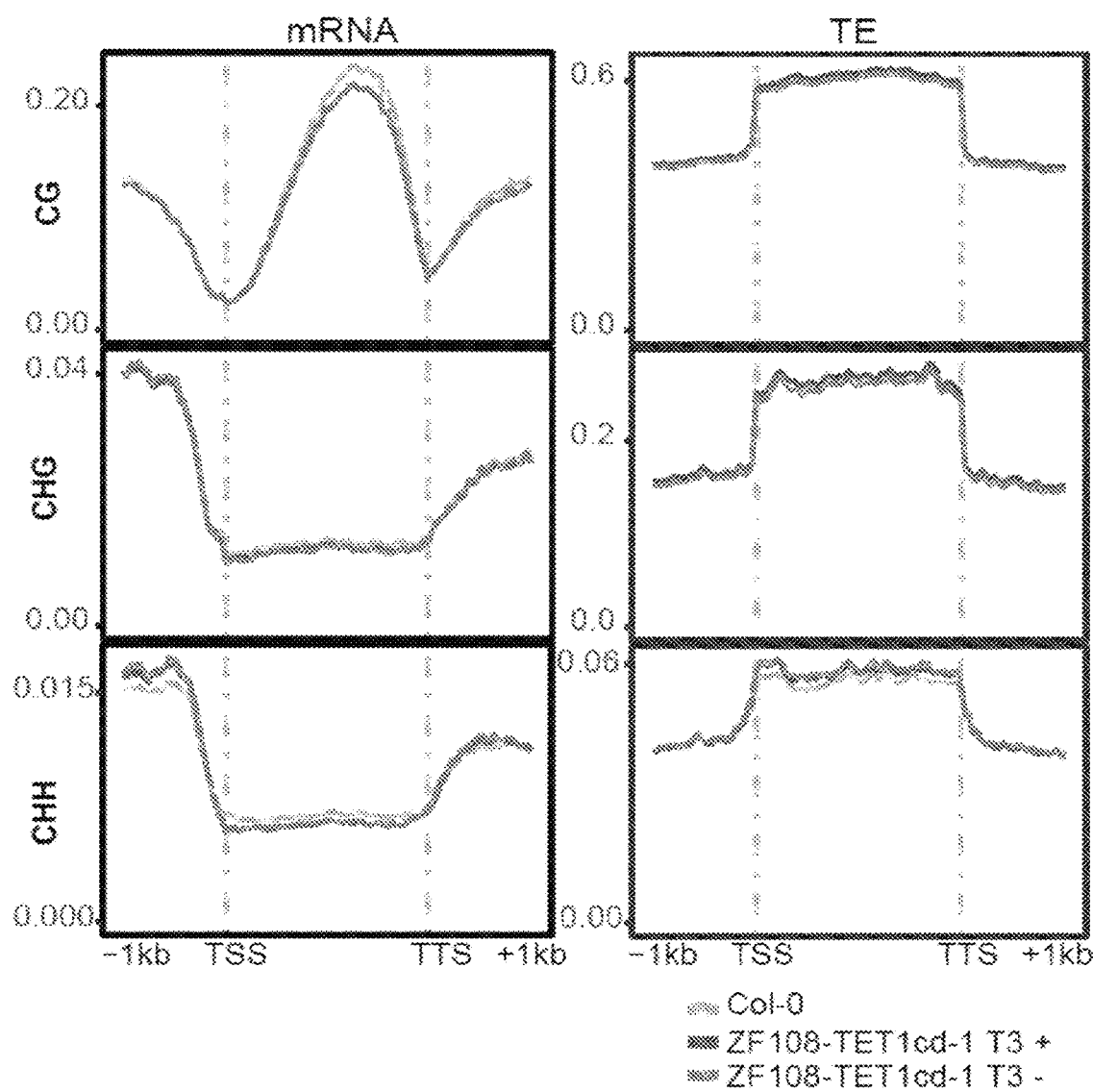

FIG. 60 illustrates a metaplot showing CG, CHG, and CHH methylation levels over all protein coding genes and TEs in one wild-type Col-0 plant, a T3 plant that retained the pUBQ10::ZF108_3xFlag_TET1-CD transgene (+) and a T3 plant that has had the transgene segregated away (−).

Figure 61:
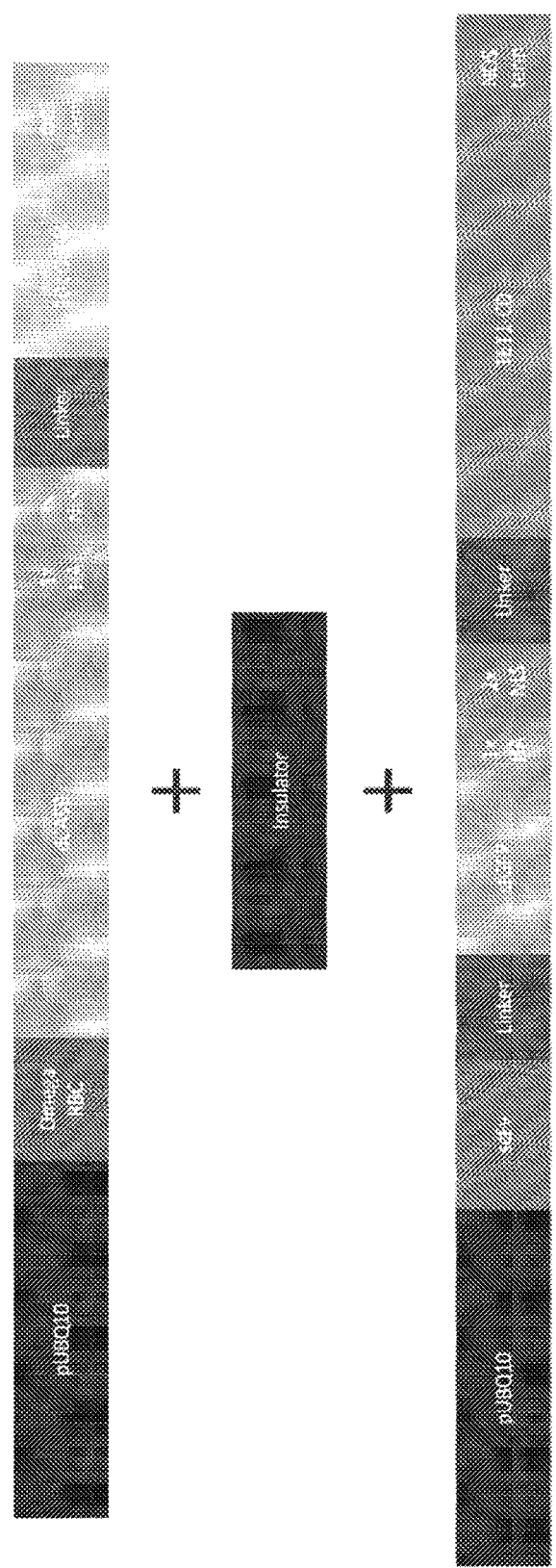

FIG. 61 illustrates a schematic of a SunTag targeting system without a specific guide RNA for expression in *Arabidopsis*.

Figure 62:
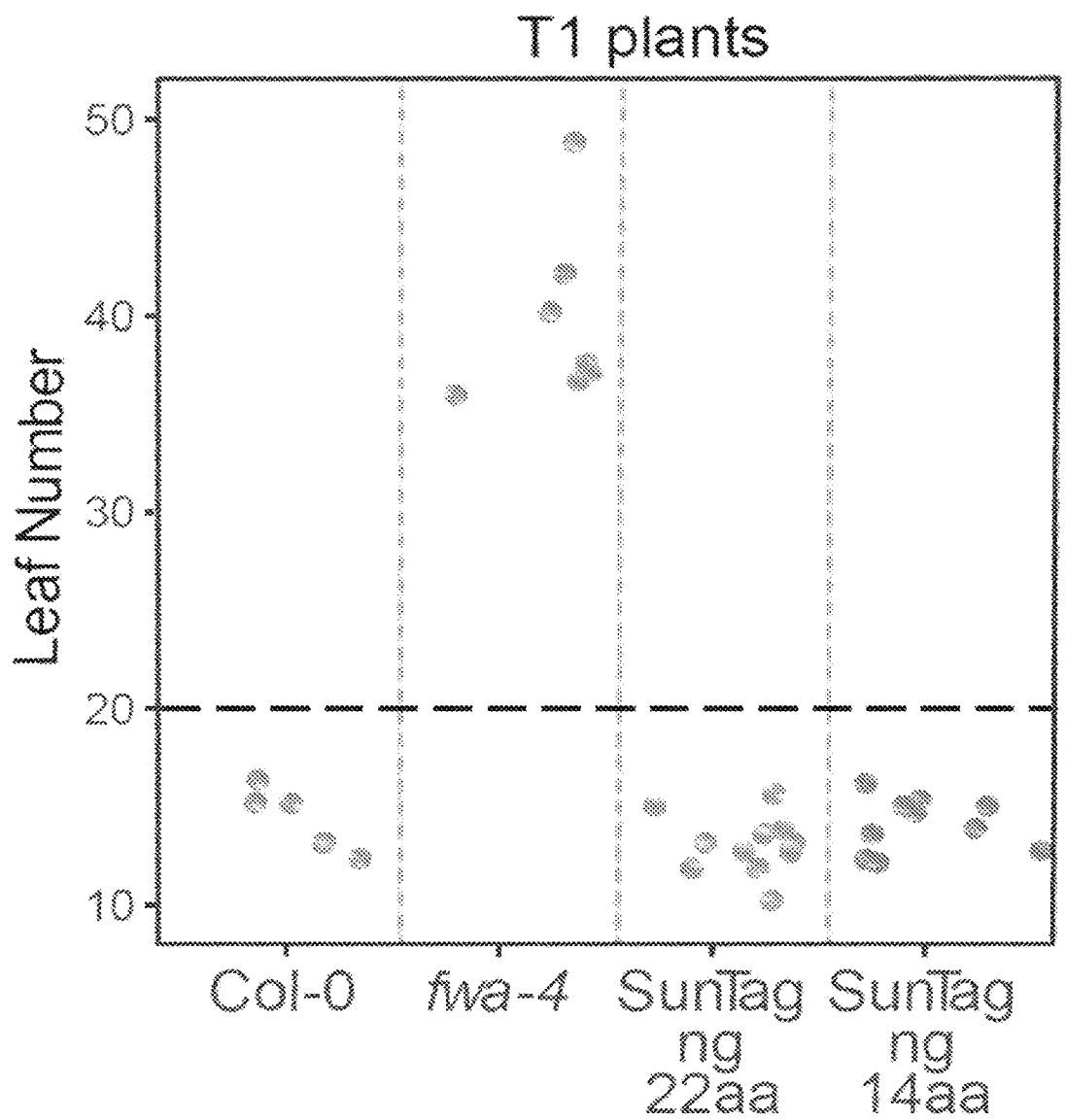

FIG. 62 illustrates the flowering time of Col-0, fwa-4 and T1 plants containing either the NOS_TET1CD_2xNLS_1xHA_sfGFP_scFv_UBQ10_INSULATOR_UBQ10_dCAS9_1xH A_3xNLS_10xGCN422aa_OCS or NOS_TET1CD_2xNLS_1xHA_sfGFP_scFv_UBQ10_INSULATOR_UBQ10_dCAS9_1xH A_3xNLS_10xGCN414aa_OCS transgene.

Figure 63:
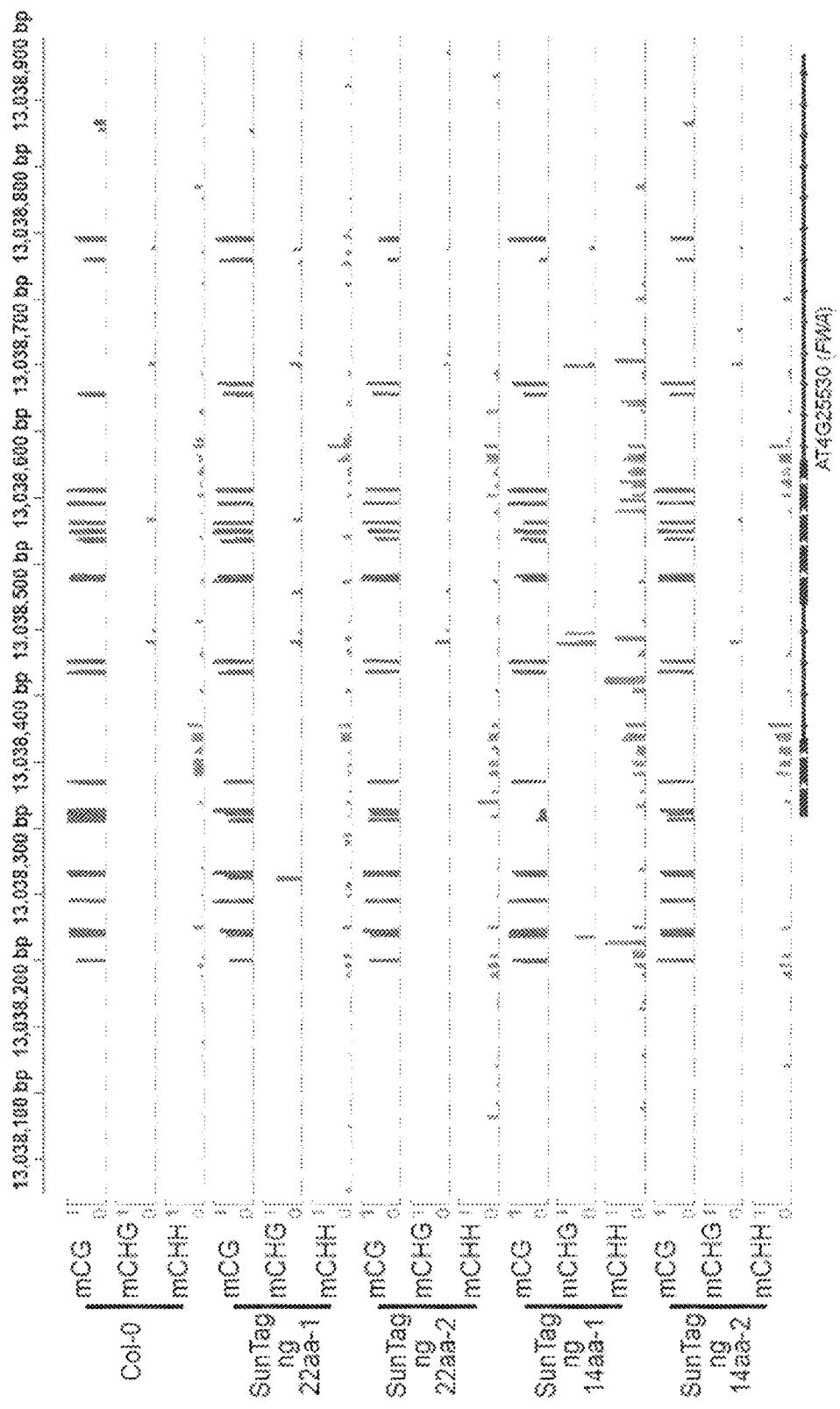

FIG. 63 illustrates Whole Genome Bisulfite Sequencing results. DNA methylation levels of one wild-type Col-0 plant and two independent T1 plants containing the NOS_TET1CD_2xNLS_1xHA_sfGFP_scFv_UBQ10_INSULATOR_UBQ10_dCAS9_1xH A_3xNLS_10xGCN422aa_OCS or NOS_TET1CD_2xNLS_1xHA_sfGFP_scFv_UBQ10_INSULATOR_UBQ10_dCAS9_1xH A_3xNLS_10xGCN414aa_OCS transgene were analyzed by BS-seq. Methylation levels of different contexts (CG, CHG and CHH, where H is C, T, or A) over an area that includes the FWA promoter are shown.

Figure 64:
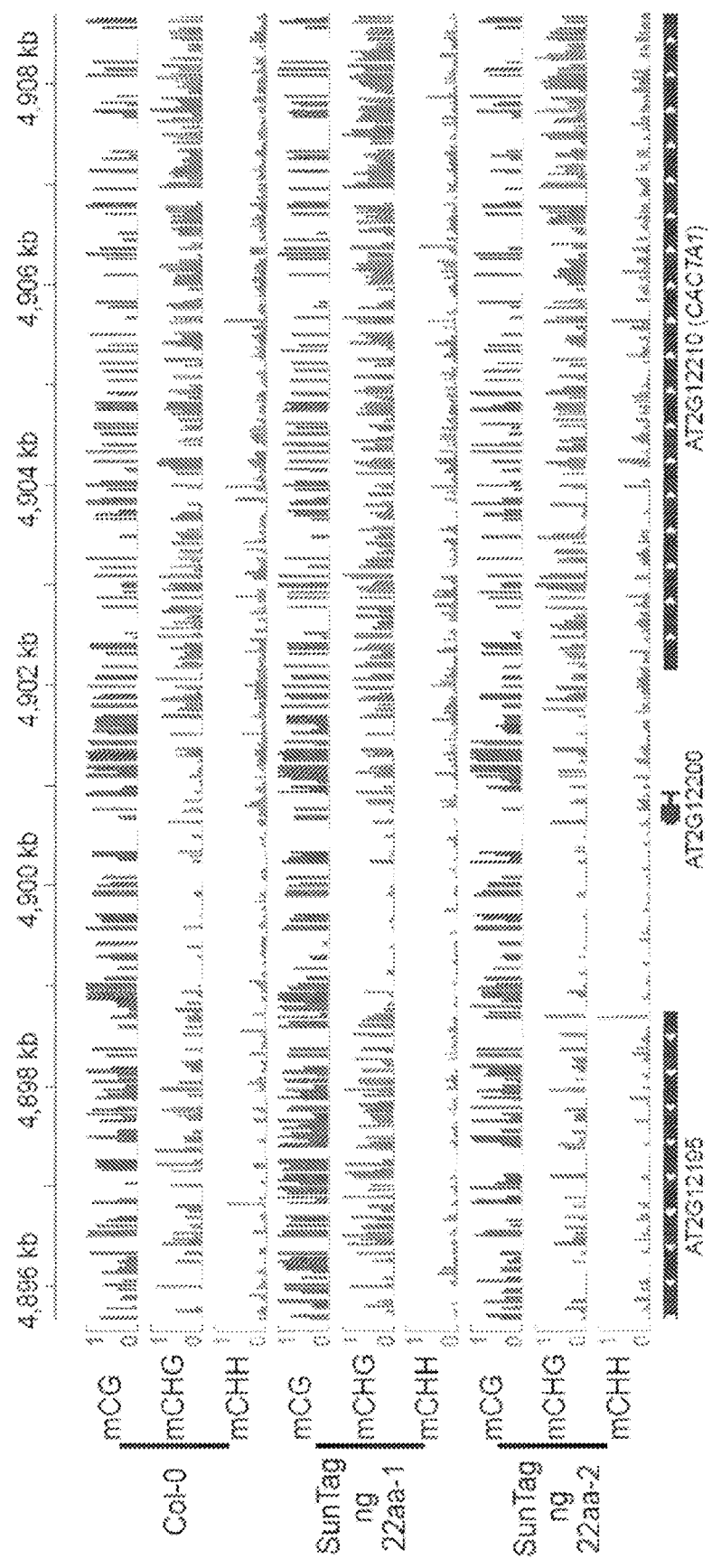

FIG. 64 illustrates Whole Genome Bisulfite Sequencing results. DNA methylation levels of one wild-type Col-0 plant and two independent T1 plants containing the NOS_TET1CD_2xNLS_1xHA_sfGFP_scFv_UBQ10_INSULATOR_UBQ10_dCAS9_1xH A_3xNLS_10xGCN422aa_OCS transgene were analyzed by BS-seq. Methylation levels of different contexts (CG, CHG and CHH, where H is C, T, or A) over an area that includes the CACTA1 promoter are shown.

Figure 65:
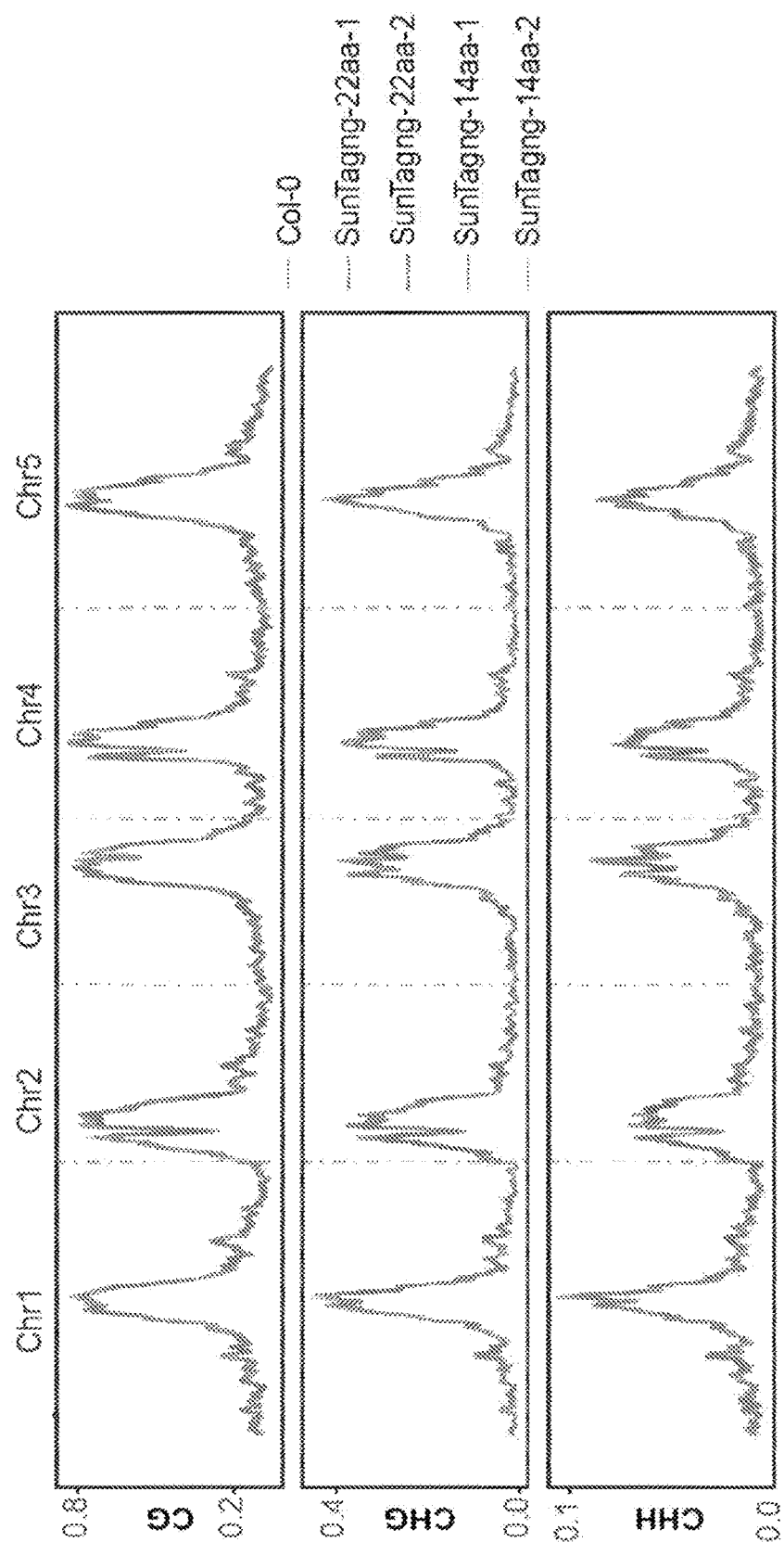

FIG. 65 illustrates the genome-wide CG, CHG and CHH methylation levels of one wild-type Col-0 plant and two independent T1 plants containing the NOS_TET1CD_2xNLS_1xHA_sfGFP_scFv_UBQ10_INSULATOR_UBQ10_dCAS9_1xH A_3xNLS_10xGCN422aa_OCS or NOS_TET1CD_2xNLS_1xHA_sfGFP_scFv_UBQ10_INSULATOR_UBQ10_dCAS9_1xH A_3xNLS_10xGCN414aa_OCS transgene.

Figure 66A:
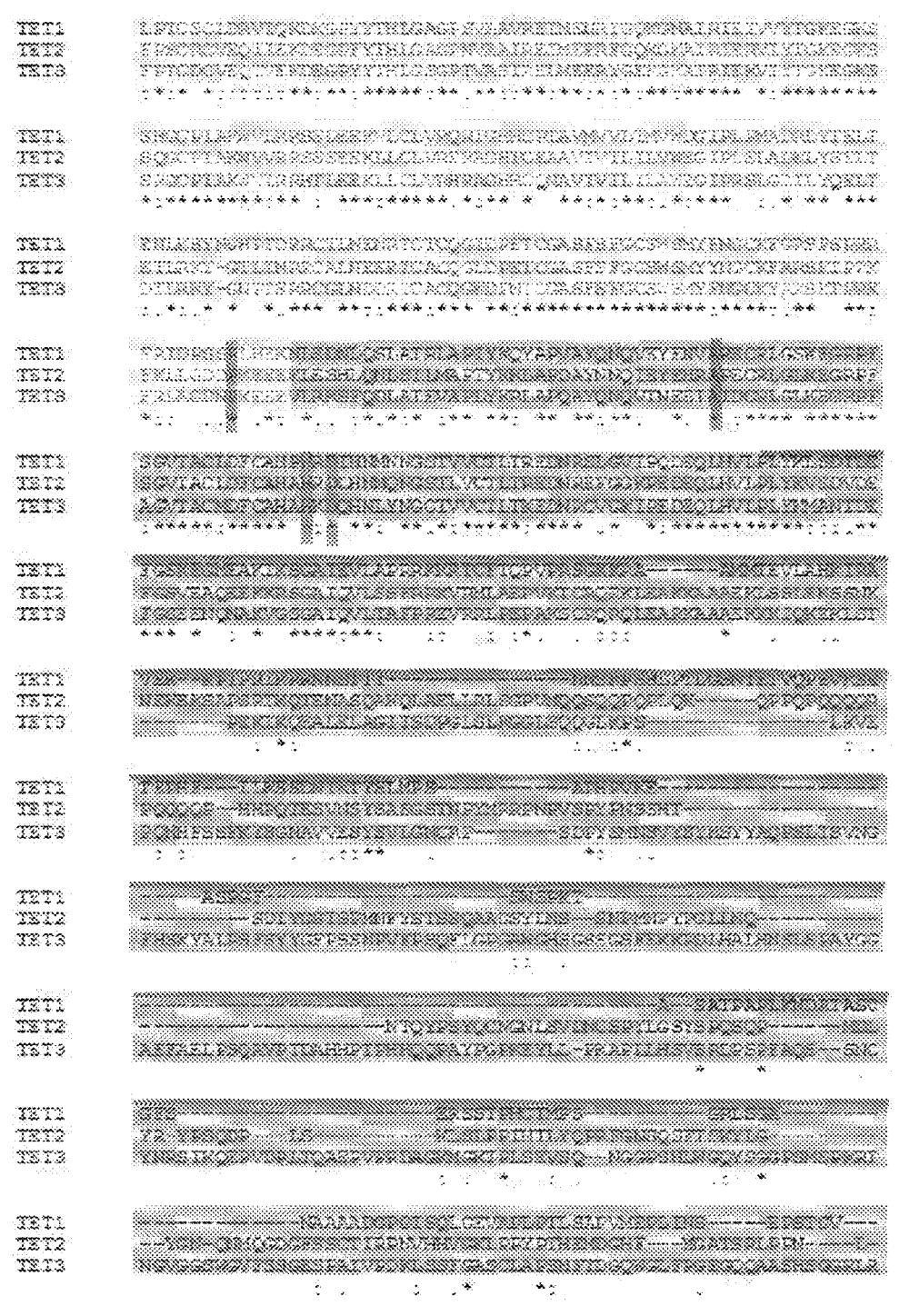
Figure 66B:
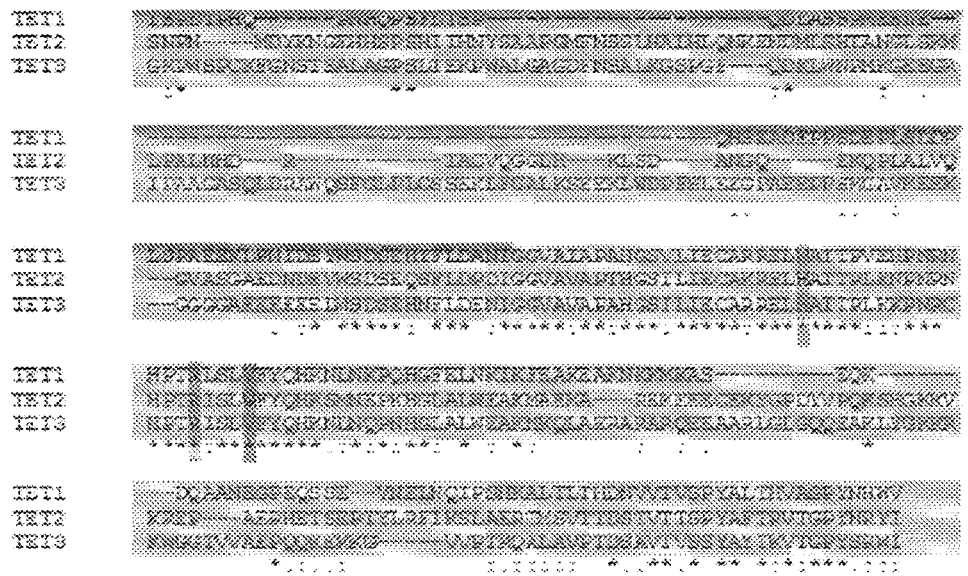

FIG. 66A-FIG. 66B illustrates an alignment of the catalytic domain of human TET1 (SEQ ID NO: 8), TET2 (SEQ ID NO: 192), and TET3 (SEQ ID NO: 194). Yellow highlighting shows the Cys-rich domain: likely to chelate two or more $Zn^{2+}$ ions via nine conserved Cys residues and one His residue. It has been postulated to be part of a DNA-binding surface that might help in target recognition (Pastor et al, 2013, Nature Rev Mol Cell Biol, Jun; 14(6): 341-356). Grey indicates the invariant P causing a kink, a unique feature of TET family. Purple highlighting indicates the dioxygenase domain. Pink indicates the His-Xaa-Asp (where Xaa is any amino acid) (SEQ ID NO: 189) and C-term His: involved in coordinating $Fe^{2+}$. The blue R residue binds to oxoglutarate via a salt bridge. Red lining above amino acid sequences indicates the CTD-like region within the DSBH domain. Purple indicates the active sites.

FIG. 67 illustrates an alignment of the Cys-rich domain of TET1 (SEQ ID NO: 196), TET2 (SEQ ID NO: 197), and TET3 (SEQ ID NO: 198).

FIG. 68 illustrates an alignment of double-stranded B-helix (DSBH) fold/Dioxygenase Domain of TET1 (SEQ ID NO: 200), TET2 (SEQ ID NO: 199), and TET3 (SEQ ID NO: 201).

DETAILED DESCRIPTION

Overview

The following description is presented to enable a person of ordinary skill in the art to make and use the various embodiments. Descriptions of specific devices, techniques, methods, and applications are provided only as examples. Various modifications to the examples described herein will be readily apparent to those of ordinary skill in the art, and the general principles defined herein may be applied to other examples and applications without departing from the spirit and scope of the various embodiments. Thus, the various embodiments are not intended to be limited to the examples described herein and shown, but are to be accorded the scope consistent with the claims.

The present disclosure relates to the use of recombinant proteins for inducing epigenetic modifications at specific loci, as well as to methods of using these recombinant proteins for modulating the expression of genes in plants.

Specifically, the present disclosure relates to the compositions and methods for targeting recombinant TET proteins (e.g. TET1 proteins) to specific nucleic acids in plants to reduce methylation of the target nucleic acid.

The present disclosure is based, at least in part, on Applicant's discovery that the catalytic domain of a human TET1 protein, when recombinantly fused to a DNA-binding domain that targets a specific nucleic acid, could be targeted to and induce DNA de-methylation at the targeted nucleic acid in plants. The targeted nucleic acid exhibited a reduced level of methylation and an increased level of expression as compared to corresponding controls. This technology could be used to selectively induce DNA de-methylation at targeted nucleic acids in plants and to create novel expression based traits for crop improvement.

Accordingly, the present disclosure provides methods and compositions for reducing methylation of a target nucleic acid in a plant by targeting a TET polypeptide (e.g. TET1 polypeptide) or fragment thereof to a target nucleic acid. Plants may be grown under conditions such that the TET polypeptide (e.g. TET1 polypeptide) or fragment thereof is targeted to the target nucleic acid, thereby reducing methylation of the target nucleic acid.

In some embodiments, the TET polypeptide (e.g. TET1 polypeptide) or fragment thereof has been engineered to specifically bind different DNA sequences via the introduction of a heterologous DNA-binding domain into the protein such as, for example, a heterologous zinc finger domain or TAL effector targeting domain. The heterologous DNA-binding domain directly facilitates targeting the TET1 polypeptide to the target nucleic acid to induce de-methylation.

In some embodiments, the TET polypeptide (e.g. TET1 polypeptide) or fragment thereof can be targeted to a specific locus of interest using a CRISPR-CAS9 targeting system. CRISPR-CAS9 systems involve the use of a CRISPR RNA (crRNA), a trans-activating CRISPR RNA (tracrRNA), and a CAS9 protein. The crRNA and tracrRNA aid in directing the CAS9 protein to a target nucleic acid sequence, and these RNA molecules can be specifically engineered to target specific nucleic acid sequences. In particular, certain aspects of the present disclosure involve the use of a single guide RNA (gRNA) that reconstitutes the function of the crRNA and the tracrRNA. Further, certain aspects of the present disclosure involve a CAS9 protein that does not exhibit DNA cleavage activity (dCAS9). As disclosed herein, gRNA molecules may be used to direct the dCAS9 protein to a target nucleic acid sequence. By recombinantly fusing a TET polypeptide (e.g. TET1 polypeptide) or fragment thereof of the present disclosure to a dCAS9 protein, use of the CRISPR targeting system allows for delivering the TET polypeptide (e.g. TET1 polypeptide) directly to a target nucleic acid.

Accordingly, the present disclosure provides methods for CRISPR-targeting of a TET polypeptide (e.g. TET1 polypeptide) to a specific locus to reduce methylation of the target locus. The TET polypeptide (e.g. TET1 polypeptide) may be recombinantly fused to a CAS9 protein, such as a nuclease-deficient CAS9 protein. The methods of the present disclosure also involve the use of a crRNA and tracrRNA to interact with the target nucleic acid. The crRNA and tracrRNA directs the recombinant protein of the present disclosure fused to a CAS9 protein to the target nucleic acid, thereby facilitating de-methylation of the target nucleic acid.

Accordingly, certain aspects of the present disclosure relate to targeting a TET-like protein (e.g. TET1-like protein) to a target nucleic acid. TET-like proteins (e.g. TET1-like proteins), or a fragment of the full-length coding sequence thereof, may contain a heterologous DNA-binding domain directly facilitates targeting the TET polypeptide (e.g. TET1 polypeptide) to the target nucleic acid to induce de-methylation. TET-like proteins (e.g. TET1-like proteins), or a fragment of the full-length coding sequence thereof, may contain a heterologous coding sequence that encodes a protein involved in the targeting and/or recruitment of the TET polypeptide (e.g. TET1 polypeptide) to a target nucleic acid via the CRISPR-CAS9 system. The TET polypeptide (e.g. TET1 polypeptide) portion of a TET-like protein (e.g. TET1-like protein) may be present in various N-terminal or C-terminal orientations relative to the heterologous coding sequence present in a TET-like protein (e.g. TET1-like protein).

The use of the terms "a," "an," and "the," and similar referents in the context of describing the disclosure (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. For example, if the range 10-15 is disclosed, then 11, 12, 13, and 14 are also disclosed. All methods described herein can be performed in any suitable order unless otherwise indicated herein or otherwise clearly contradicted by context. The use of any and all examples, or exemplary language (e.g., "such as") provided herein, is intended merely to better illuminate the embodiments of the disclosure and does not pose a limitation on the scope of the disclosure unless otherwise claimed. No language in the specification should be construed as indicating any non-claimed element as essential to the practice of the embodiments of the disclosure.

Reference to "about" a value or parameter herein refers to the usual error range for the respective value readily known to the skilled person in this technical field. Reference to "about" a value or parameter herein includes (and describes) aspects that are directed to that value or parameter per se. For example, description referring to "about X" includes description of "X."

It is understood that aspects and embodiments of the present disclosure described herein include "comprising," "consisting," and "consisting essentially of" aspects and embodiments.

It is to be understood that one, some, or all of the properties of the various embodiments described herein may be combined to form other embodiments of the present disclosure. These and other aspects of the present disclosure will become apparent to one of skill in the art. These and other embodiments of the present disclosure are further described by the detailed description that follows.

The terms "isolated" and "purified" as used herein refers to a material that is removed from at least one component with which it is naturally associated (e.g., removed from its original environment). The term "isolated," when used in reference to an isolated protein, refers to a protein that has been removed from the culture medium of the host cell that expressed the protein. As such an isolated protein is free of extraneous or unwanted compounds (e.g., nucleic acids, native bacterial or other proteins, etc.).

DNA-Binding Domains

Certain aspects of the present disclosure relate to TET-like proteins (e.g. TET1-like proteins) that have DNA-binding activity. In some embodiments, this DNA-binding activity is achieved through a heterologous DNA-binding domain (e.g. binds with a sequence affinity other than that of a DNA-binding domain that may be present in the endogenous protein). In some embodiments, TET-like proteins (e.g. TET1-like proteins) of the present disclosure contain a DNA-binding domain. TET-like proteins (e.g. TET1-like proteins) of the present disclosure may contain one DNA binding domain or they may contain more than one DNA-binding domain. Heterologous DNA-binding domains may be recombinantly fused to a TET protein (e.g. TET1 protein) of the present disclosure such that the resulting TET-like protein (e.g. TET1-like protein) is then targeted to a specific nucleic acid sequence and can induce demethylation of the specific nucleic acid sequence.

In some embodiments, the DNA-binding domain is a zinc finger domain. A zinc finger domain generally refers to a DNA-binding protein domain that contains zinc fingers, which are small protein structural motifs that can coordinate one or more zinc ions to help stabilize their protein folding. Zinc fingers were first identified as DNA-binding motifs (Miller et al., 1985), and numerous other variations of them have been characterized. Progress has been made that allows the engineering of DNA-binding proteins that specifically recognize any desired DNA sequence. For example, it was shown that a three-finger zinc finger protein could be constructed to block the expression of a human oncogene that was transformed into a mouse cell line (Choo and Klug, 1994).

Zinc fingers can generally be classified into several different structural families and typically function as interaction modules that bind DNA, RNA, proteins, or small molecules. Suitable zinc finger domains of the present disclosure may contain two, three, four, five, six, seven, eight, or nine zinc fingers. Examples of suitable zinc finger domains may include, for example, Cys2His2 (C2H2) zinc finger domains, C-x8-C-x5-C-x3-H (CCCH) zinc finger domains, multi-cysteine zinc finger domains, and zinc binuclear cluster domains.

In some embodiments, the DNA-binding domain binds a specific nucleic acid sequence. For example, the DNA-binding domain may bind a sequence that is at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 20 nucleotides, at least 25 nucleotides, at least 30 nucleotides, at least 35 nucleotides, at least 40 nucleotides, at least 45 nucleotides, at least 50 nucleotides, or a high number of nucleotides in length.

In some embodiments, a recombinant protein of the present disclosure further contains two N-terminal CCCH zinc finger domains.

In some embodiments, the zinc finger domain is an engineered zinc finger array, such as a C2H2 zinc finger array. Engineered arrays of C2H2 zinc fingers can be used to create DNA-binding proteins capable of targeting desired genomic DNA sequences. Methods of engineering zinc finger arrays are well known in the art, and include, for example, combining smaller zinc fingers of known specificity.

In some embodiments, recombinant proteins of the present disclosure may contain a DNA-binding domain other than a zinc finger domain. Examples of such DNA-binding domains may include, for example, TAL (transcription activator-like) effector targeting domains, helix-turn-helix family DNA-binding domains, basic domains, ribbon-helix-helix domains, TBP (TATA-box binding protein) domains, barrel dimer domains, RHB domains (real homology domain), BAH (bromo-adjacent homology) domains, SANT domains, Chromodomains, Tudor domains, Bromodomains, PHD domains (plant homeo domain), WD40 domains, and MBD domains (methyl-CpG-binding domain).

In some embodiments, the DNA-binding domain is a TAL effector targeting domain. TAL effectors generally refer to secreted bacterial proteins, such as those secreted by *Xanthomonas* or *Ralstonia* bacteria when infecting various plant species. Generally, TAL effectors are capable of binding promoter sequences in the host plant, and activate the expression of plant genes that aid in bacterial infection. TAL effectors recognize plant DNA sequences through a central repeat targeting domain that contains a variable number of approximately 34 amino acid repeats. Moreover, TAL effector targeting domains can be engineered to target specific DNA sequences. Methods of modifying TAL effector targeting domains are well known in the art, and described in Bogdanove and Voytas, Science. 2011 Sep. 30; 333(6051): 1843-6.

Other DNA-binding domains for use in the methods and compositions of the present disclosure will be readily apparent to one of skill in the art, in view of the present disclosure.

CRISPR-CAS9

Certain methods of the present disclosure relate to using a CRISPR-CAS9 targeting system to target a TET protein (e.g. TET1 protein) to a target nucleic acid and induce demethylation of the target nucleic acid.

CRISPR systems naturally use small base-pairing guide RNAs to target and cleave foreign DNA elements in a sequence-specific manner (Wiedenheft et al., 2012). There are diverse CRISPR systems in different organisms that may be used to target proteins of the present disclosure to a target nucleic acid. One of the simplest systems is the type II CRISPR system from *Streptococcus pyogenes*. Only a single gene encoding the CAS9 protein and two RNAs, a mature CRISPR RNA (crRNA) and a partially complementary trans-acting RNA (tracrRNA), are necessary and sufficient for RNA-guided silencing of foreign DNAs (Jinek et al., 2012). Maturation of crRNA requires tracrRNA and RNase III (Deltcheva et al., 2011). However, this requirement can be bypassed by using an engineered small guide RNA (gRNA) containing a designed hairpin that mimics the tracrRNA-crRNA complex (Jinek et al., 2012). Base pairing between the gRNA and target DNA normally causes double-strand breaks (DSBs) due to the endonuclease activity of CAS9.

It is known that the endonuclease domains of the CAS9 protein can be mutated to create a programmable RNA-dependent DNA-binding protein (dCAS9) (Qi et al., 2013). The fact that duplex gRNA-dCAS9 binds target sequences without endonuclease activity has been used to tether regulatory proteins, such as transcriptional activators or repressors, to promoter regions in order to modify gene expression (Gilbert et al., 2013), and CAS9 transcriptional activators have been used for target specificity screening and paired nickases for cooperative genome engineering (Mali et al., 2013, Nature Biotechnology 31:833-838). Thus, dCAS9 may be used as a modular RNA-guided platform to recruit different proteins to DNA in a highly specific manner. One of skill in the art would recognize other RNA-guided DNA binding protein/RNA complexes that can be used equivalently to CRISPR-CAS9.

The CRISPR-CAS9 system may be used to target a TET1 protein of the present disclosure to a specific nucleic acid. Targeting using CRISPR-CAS9 may be beneficial over other genome targeting techniques in certain instances. For example, one need only change the guide RNAs in order to target fusion proteins to a new genomic location, or even multiple locations simultaneously. In addition, guide RNAs can be extended to include sites for binding to proteins, such as the MS2 protein, which can be fused to proteins of interest.

CAS9 Proteins

A variety of CAS9 proteins may be used in the methods of the present disclosure. There are several CAS9 genes present in different bacteria species (Esvelt, K et al, 2013, Nature Methods). One of the most characterized CAS9 proteins is the CAS9 protein from *S. pyogenes* that, in order to be active, needs to bind a gRNA with a specific sequence and the presence of a PAM motif (NGG, where N is any nucleotide) at the 3' end of the target locus. However, other CAS9 proteins from different bacterial species show differences in 1) the sequence of the gRNA they can bind and 2) the sequence of the PAM motif. Therefore, it is possible that other CAS9 proteins such as, for example, those from *Streptococcus thermophilus* or *N. meningitidis* may also be utilized herein. Indeed, these two CAS9 proteins have a smaller size (around 1100 amino acids) as compared to *S. pyogenes* CAS9 (1400 amino acids), which may confer some advantages during cloning or protein expression.

CAS9 proteins from a variety of bacteria have been used successfully in engineered CRISPR-CAS9 systems. There are also versions of CAS9 proteins available in which the codon usage has been more highly optimized for expression in eukaryotic systems, such as human codon optimized CAS9 (Cell, 152:1173-1183) and plant optimized CAS9 (Nature Biotechnology, 31:688-691).

CAS9 proteins may also be modified for various purposes. For example, CAS9 proteins may be engineered to contain a nuclear-localization sequence (NLS). CAS9 proteins may be engineered to contain an NLS at the N-terminus of the protein, at the C-terminus of the protein, or at both the N- and C-terminus of the protein. Engineering a CAS9 protein to contain an NLS may assist with directing the protein to the nucleus of a host cell. CAS9 proteins may be engineered such that they are unable to cleave nucleic acids (e.g. nuclease-deficient dCAS9 polypeptides). One of skill in the art would be able to readily identify a suitable CAS9 protein for use in the methods and compositions of the present disclosure.

Exemplary CAS9 proteins that may be used in the methods and compositions of the present disclosure may include, for example, a CAS9 protein having the amino acid sequence of any one of SEQ ID NO: 15, SEQ ID NO: 16, and/or SEQ ID NO: 17, homologs thereof, and fragments thereof.

In some embodiments, a CAS9 polypeptide or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 15, SEQ ID NO: 16, SEQ ID NO: 17, or SEQ ID NO: 125. In some embodiments, the CAS9 polypeptide does not have nuclease activity and is unable to cleave a nucleic acid molecule (e.g. dCAS9 polypeptide).

CRISPR RNAs

The CRISPR RNA (crRNA) of the present disclosure may take a variety of forms. As described above, the sequence of the crRNA is involved in conferring specificity to targeting a specific nucleic acid.

Many different crRNA molecules can be designed to target many different sequences. With respect to targeting, target nucleic acids generally require the PAM sequence, NGG, at the end of the 20 base pair target sequence. crRNAs of the present disclosure may be expressed as a single crRNA molecule, or they may be expressed in the form of a crRNA/tracrRNA hybrid molecule where the crRNA and the tracrRNA have been fused together, forming a guide RNA (gRNA). crRNA molecules and/or guide RNA molecules may be extended to include sites for the binding of RNA binding proteins.

Multiple crRNAs and/or guide RNAs can be encoded into a single CRISPR array to enable simultaneous targeting to several sites (Science 2013: Vol. pp. 819-823). For example, the tracrRNA may be expressed separately, and two adjacent target sequences may be encoded in a pre-crRNA array interspaced with repeats.

A variety of promoters may be used to drive expression of the crRNA and/or the guide RNA. crRNAs and/or guide RNAs may be expressed using a Pol III promoter such as, for example, the U6 promoter or the H1 promoter (eLife 2013 2:e00471). For example, an approach in plants has been described using three different Pol III promoters from three different *Arabidopsis* U6 genes, and their corresponding gene terminators (BMC Plant Biology 2014 14:327). One skilled in the art would readily understand that many additional Pol III promoters could be utilized to simultaneously express many crRNAs and/or guide RNAs to many different locations in the genome simultaneously. The use of different Pol III promoters for each crRNA and/or gRNA expression cassette may be desirable to reduce the chances of natural gene silencing that can occur when multiple copies of identical sequences are expressed in plants. In addition, crRNAs and/or guide RNAs can be modified to improve the efficiency of their function in guiding CAS9 to a target nucleic acid. For example, it has been shown that adding either 8 or 20 additional nucleotides to the gRNA in order to extend the hairpin by 4 or 10 base pairs resulted in more efficient CAS9 activity (eLife 2013 2:e00471).

Alternatively, a tRNA-gRNA expression cassette (Xie, X et al, 2015, Proc Natl Acad Sci USA. 2015 Mar. 17; 112(11):3570-5) may be used to deliver multiple gRNAs simultaneously with high expression levels.

Trans-Activating CRISPR RNAs

The trans-activating CRISPR RNA (tracrRNA) of the present disclosure may take a variety of forms, as will be readily understood by one of skill in the art. As described above, tracrRNAs are involved in the maturation of a crRNA. tracrRNAs of the present disclosure may be expressed as a single tracrRNA molecule, or they may be expressed in the form of a crRNA/tracrRNA hybrid molecule where the crRNA and the tracrRNA have been fused together, forming a guide RNA (gRNA). tracrRNA molecules and/or guide RNA molecules may be extended to include sites for the binding of RNA binding proteins.

As CRISPR systems naturally exist in a variety of bacteria, the framework of the crRNA and tracrRNA in these bacteria may be adapted for use in the methods and compositions described herein. crRNAs, tracrRNAs, and/or guide RNAs of the present disclosure may be constructed based on the framework of one or more of these molecules in, for example, *S. pyogenes, Streptococcus thermophilus,* and/or *N. meningitidis*. For example, a guide RNA of the present disclosure may be constructed based on the framework of the crRNA and tracrRNA from *S. pyogenes* (SEQ ID NO: 18), *Streptococcus thermophilus* (SEQ ID NO: 19), and/or *N. meningitidis* (SEQ ID NO: 20). In these exemplary frameworks, the 5' end of the sequence contains 20 generic nucleotides (N) that correspond to the crRNA targeting sequence. This sequence will vary depending on the sequence of the particular nucleic acid being targeted.

Linkers

Various linkers may be used in the construction of recombinant proteins as described herein. In general, linkers are short peptides that separate the different domains in a multi-domain protein. They may play an important role in fusion proteins, affecting the crosstalk between the different domains, the yield of protein production, and the stability and/or the activity of the fusion proteins. Linkers are generally classified into 2 major categories: flexible or rigid. Flexible linkers are typically used when the fused domains require a certain degree of movement or interaction, and these linkers are usually composed of small amino acids such as, for example, glycine (G), serine (S) or proline (P).

The certain degree of movement between domains allowed by flexible linkers is an advantage in some fusion proteins. However, it has been reported that flexible linkers can sometimes reduce protein activity due to an inefficient separation of the two domains. In this case, rigid linkers may be used since they enforce a fixed distance between domains and promote their independent functions. A thorough description of several linkers has been provided in Chen X et al., 2013, Advanced Drug Delivery Reviews 65 (2013) 1357-1369).

Various linkers may be used in, for example, the construction of recombinant TET1 polypeptides that are fused to a CAS9 protein as described herein. Linkers may be used in the TET1-CAS9 fusion proteins described herein to separate the coding sequences of a TET1 polypeptide and a CAS9 protein. For example, a variety of wiggly/flexible linkers, stiff/rigid linkers, short linkers, and long linkers may be used as described herein. Various linkers as described herein may be used in the construction of TET1-like proteins as described herein.

A variety of shorter or longer linker regions are known in the art, for example corresponding to a series of glycine residues, a series of adjacent glycine-serine dipeptides, a series of adjacent glycine-glycine-serine tripeptides, or known linkers from other proteins. A flexible linker may include, for example, the amino acid sequence: SSGPPPGTG (SEQ ID NO: 164) and variants thereof. A rigid linker may include, for example, the amino acid sequence: AEAAAKEAAAKA (SEQ ID NO: 165) and variants thereof. The XTEN linker, SGSETPGTSESATPES (SEQ ID NO: 166), and variants thereof, described in Guilinget et al, 2014 (Nature Biotechnology 32, 577-582), may also be used. This particular linker was previously shown to produce the best results among other linkers in a protein fusion between dCAS9 and the nuclease FokI.

The linkers having the nucleotide sequences presented in SEQ ID NO: 139 and SEQ ID NO: 140 may also be used in the methods and compositions as described herein. The linker having the amino acid sequence presented in SEQ ID NO: 141 may also be used in the methods and compositions as described herein.

Variations of CRISPR-CAS9 Targeting

Certain aspects of the present disclosure relate to recombinantly fusing a TET polypeptide (e.g. TET1 polypeptide) of the present disclosure to a CAS9 protein. However, CRISPR-CAS9 targeting schemes as described herein to target a specific nucleic acid may also involve schemes where a polypeptide of the present disclosure is targeted to a specific nucleic acid without being recombinantly fused to a CAS9 protein.

The use of recombinant proteins containing a TET polypeptide (e.g. TET1 polypeptide) recombinantly fused to an RNA-binding protein may be used in targeting of the TET polypeptide (e.g. TET1 polypeptide) to a specific nucleic acid via CRISPR-CAS9 targeting. In some embodiments, a TET polypeptide (e.g. TET1 polypeptide) is recombinantly fused to an MS2 coat protein such that these fusion proteins may be directed to a target nucleic acid with the assistance of a CAS9 protein. In some embodiments, MS2 targeting systems may involve a fusion of a TET polypeptide (e.g. TET1 polypeptide) to a dCAS9 polypeptide. In some embodiments, the TET-dCAS9 fusion (e.g. TET1-dCAS9 fusion) is a direct fusion. In some embodiments, the TET-dCAS9 fusion (e.g. TET1-dCAS9 fusion) is an indirect fusion.

Various MS2 coat proteins may be used, such as SEQ ID NO: 52 and homologs thereof. This targeting scheme is further described herein and will be readily understood by one of skill in the art in view of the present disclosure.

In addition to fusing a TET polypeptide (e.g. TET1 polypeptide) to an MS2 coat protein, other RNA-binding proteins may also be used in this targeting scheme. For example, the proteins PP7 and COM (Zalatan et al., Cell 160, 339-350), may also be recombinantly fused to a TET polypeptide (e.g. TET1 polypeptide) such that these fusion proteins may be directed to a target nucleic acid with the assistance of a CAS9 protein.

The use of recombinant proteins containing a TET polypeptide (e.g. TET1 polypeptide) recombinantly fused to an antibody or fragment thereof may be used in targeting of the TET polypeptide (e.g. TET1 polypeptide) to a specific nucleic acid via CRISPR-CAS9 targeting. In some embodiments, a TET polypeptide (e.g. TET1 polypeptide) is recombinantly fused to an scFV antibody such that these fusion proteins may be directed to a target nucleic acid with the assistance of a CAS9 protein. Various scFV antibodies may be used, such as SEQ ID NO: 53 and homologs thereof. This targeting scheme is further described herein and will be readily understood by one of skill in the art in view of the present disclosure.

Similar systems using antibody mimetic proteins or proteins which can bind other proteins may also be used in the methods described herein. For example, designed ankyrin repeat proteins (DARPins), which are small and highly stable proteins that can bind their epitopes with strong affinity (Binz et al., 2004, Nat. Biotechnol. 22, 575-582), may be recombinantly fused to a TET polypeptide (e.g. TET1 polypeptide) such that these fusion proteins may be directed to a target nucleic acid with the assistance of a CAS9 protein.

SunTag Systems

Certain aspects of the present disclosure relate to the use of SunTag systems for targeting (using CRISPR-based targeting) a TET polypeptide (e.g. TET1 polypeptide) of the present disclosure to a target nucleic acid. A synthetic system was previously developed for use in mammals for recruiting multiple copies of a protein to a target polypeptide chain, and this system was called a SunTag system (Tanenbaum et al., 2014)(WO2016011070). This system was also adapted so that the multiple copies of the protein using the SunTag system could be targeted to a nucleic acid using the CRISPR-Cas9 system (Tanenbaum et al., 2014). However, this system was developed for use in mammals. Provided herein are methods and compositions for SunTag systems adapted to target TET polypeptides (e.g. TET1 polypeptides) to specific loci in plants.

Accordingly, the present disclosure provides methods and compositions for the recruitment of multiple copies of a TET polypeptide (e.g. TET1 polypeptide) to a target nucleic acid in plants via CRISPR-based targeting in a manner that allows for demethylation and/or activation of the target nucleic acid. In certain aspects, this specific targeting involves the use of a system that includes (1) a nuclease-deficient CAS9 polypeptide that is recombinantly fused to a multimerized epitope, (2) a TET polypeptide (e.g. TET1 polypeptide) that is recombinantly fused to an affinity polypeptide, and (3) a guide RNA (gRNA). In this aspect, the dCAS9 portion of the dCAS9-multimerized epitope fusion protein is involved with targeting a target nucleic acid as directed by the guide RNA. The multimerized epitope portion of the dCAS9-multimerized epitope fusion protein is involved with binding to the affinity polypeptide (which is recombinantly fused to a TET polypeptide (e.g. TET1 polypeptide)). The affinity polypeptide portion of the TET polypeptide (e.g. TET1 polypeptide)-affinity polypeptide fusion protein is involved with binding to the multimerized epitope so that the TET polypeptide (e.g. TET1 polypeptide) can be in association with dCAS9. The TET polypeptide (e.g. TET1 polypeptide) portion of the TET polypeptide (e.g. TET1 polypeptide)-affinity polypeptide fusion protein is involved with inducing demethylation and/or activation of a target nucleic acid, once the complex has been targeted to a target nucleic acid via the guide RNA.

As described above, SunTag systems involve targeting based on CRISPR-CAS9 systems. CRISPR-CAS9 systems are described above. The features of CRISPR-CAS9 systems may be used in SunTag systems of the present disclosure as appropriate, as will be readily understood by one of skill in the art.

Affinity Polypeptides

Certain aspects of the present disclosure relate to recombinant polypeptides that contain an affinity polypeptide. Affinity polypeptides of the present disclosure may bind to one or more epitopes (e.g. a multimerized epitope). In some embodiments, an affinity polypeptide is present in a recombinant polypeptide that contains a TET polypeptide (e.g. TET1 polypeptide) and an affinity polypeptide.

A variety of affinity polypeptides are known in the art and may be used herein. Generally, the affinity polypeptide should be stable in the conditions present in the intracellular environment of a plant cell. Additionally, the affinity polypeptide should specifically bind to its corresponding epitope with minimal cross-reactivity.

The affinity polypeptide may be an antibody such as, for example, an scFv. The antibody may be optimized for stability in the plant intracellular environment. When a GCN4 epitope is used in the methods described herein, a suitable affinity polypeptide that is an antibody may contain an anti-GCN4 scFv domain.

In embodiments where the affinity polypeptide is an scFv antibody, the polypeptide may contain an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of SEQ ID NO: 132.

Other exemplary affinity polypeptides include, for example, proteins with SH2 domains or the domain itself, 14-3-3 proteins, proteins with SH3 domains or the domain itself, the Alpha-Syntrophin PDZ protein interaction domain, the PDZ signal sequence, or proteins from plants which can recognize AGO hook motifs (e.g. AGO4 from *Arabidopsis thaliana*).

Additional affinity polypeptides that may be used in the methods and compositions described herein will be readily apparent to those of skill in the art.

Epitopes and Multimerized Epitopes

Certain aspects of the present disclosure relate to recombinant polypeptides that contain an epitope or a multimerized epitope. Epitopes of the present disclosure may bind to an affinity polypeptide. In some embodiments, an epitope or multimerized epitope is present in a recombinant polypeptide that contains a dCAS9 polypeptide.

Epitopes of the present disclosure may be used for recruiting affinity polypeptides (and any polypeptides they may be recombinantly fused to) to a dCAS9 polypeptide. In embodiments where a dCAS9 polypeptide is fused to an epitope or a multimerized epitope, the dCAS9 polypeptide may be fused to one copy of an epitope, multiple copies of an epitope, more than one different epitope, or multiple copies of more than one different epitope as further described herein.

A variety of epitopes and multimerized epitopes are known in the art and may be used herein. In general, the epitope or multimerized epitope may be any polypeptide sequence that is specifically recognized by an affinity polypeptide of the present disclosure. Exemplary epitopes may include a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, a VSV-G epitope, and a GCN4 epitope.

Other exemplary amino acid sequences that may serve as epitopes and multimerized epitopes include, for example, phosphorylated tyrosines in specific sequence contexts recognized by SH2 domains, characteristic consensus sequences containing phosphoserines recognized by 14-3-3 proteins, proline rich peptide motifs recognized by SH3 domains, the PDZ protein interaction domain or the PDZ signal sequence, and the AGO hook motif from plants.

Epitopes described herein may also be multimerized. Multimerized epitopes may include at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, or at least 24 or more copies of an epitope.

Multimerized epitopes may be present as tandem copies of an epitope, or each individual epitope may be separated from another epitope in the multimerized epitope by a linker or other amino acid sequence. Suitable linker regions are known in the art and are described herein. The linker may be configured to allow the binding of affinity polypeptides to adjacent epitopes without substantial steric hindrance. Linker sequences may also be configured to provide an unstructured or linear region of the polypeptide to which they are recombinantly fused. The linker sequence may comprise e.g. one or more glycines and/or serines. The linker sequences may be e.g. at least 2, at least 3, at least 4, at least 5, at least 6, at least 7, at least 8, at least 9, or at least 10 or more amino acids in length. The linker sequences may be e.g. 5-10, 10-15, 15-20, or 20-25 amino acids in length.

In some embodiments, the epitope is a GCN4 epitope (SEQ ID NO: 138). In some embodiments, the multimerized epitope contains at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, or at least 24 copies of a GCN4 epitope. In some embodiments, the multimerized epitope contains 10 copies of a GCN4 epitope.

Additional epitopes and multimerized epitopes that may be used in the methods and compositions described herein will be readily apparent to those of skill in the art.

Recombinant Polypeptides

Certain aspects of the present disclosure relate to reducing methylation of a target nucleic acid in a plant by expressing recombinant TET polypeptides in plants. Exemplary TET polypeptides include TET1, TET2, and TET3. Ten-eleven translocation (TET) proteins are known in the art. It has been shown that expressing TET proteins in cell lines leads to a reduction in 5mC levels and leads to the formation of 5hmC. Mutations in the signature His-Xaa-Asp motif (where Xaa represents any amino acid) of these dioxygenases abolishes this activity. His-Xaa-Asp is presented herein as SEQ ID NO: 189. The TET protein family members also share a conserved cysteine-rich region in addition to the dioxygenase motifs (DSBH) role in Fe(II) and oxoglutarate binding. In the presence of the necessary cofactors 2-oxoglutarate and $Fe^{2+}$, TET proteins can efficiently convert 5mC to 5hmC in vitro, and further oxidize to 5fC and 5caC.

There is conservation of the amoeba NgTet1 with mouse mTet1 and human hTET1 catalytic domain. The NgTet1 can catalyze the conversion of 5mC to 5hmC, and its structure represents the core structure of the catalytic domains of human TET enzymes. Humans TETs have an atypical non-conserved insertion between the two halves of the His-Xaa-Asp and C-term His residues called CTD-like. In addition human TETs have a unique Cis-rich domain at the N-term (residues 1525-1572 in hTET1). Removing these two insertions shows that NgTet1 and mammalian TETs share 14% identity or 39% similarity. However, both can perform the same catalytic activity. Another conservation involves (i) an invariant proline causing a kink of helix α4 and (ii) helices α5 and α6 which are composed of a stretch of residues predicted to be Tet/JBP specific (See Hashimoto et al, 2014 Feb. 20: 506(7488):391-5). An alignment of the TET catalytic domains is presented in FIG. 66A and FIG. 66B. Other TET protein alignments are presented in FIG. 67 and FIG. 68.

TET proteins are generally considered to be methylcytosine dioxygenases. Certain aspects of the present disclosure relate to use of dioxygenases to reduce methylation of a target nucleic acid. In some embodiments, the catalytic domain of the dioxygenase is used in the methods described herein. The dioxygenase may be a TET polypeptide such as e.g. a TET1 polypeptide, a TET2 polypeptide, a TET3 polypeptide, or the catalytic domain of said polypeptides. In some embodiments, the TET polypeptide includes the amino acid sequence set forth in SEQ ID NO: 189 or SEQ ID NO: 190.

Certain aspects of the present disclosure relate to use of dioxygenases that use molecular oxygen and the cofactors Fe(II) and 2-oxoglutarate to convert 5-methylcytosine (5mC) to 5-hydroxymethylcytosine (5hmC), 5-formylcytosine (5fC), and 5-carboxylcytosine DNA (together referred to as oxidized methylcytosines or oxi-mC) to reduce methylation of a target nucleic acid.

Certain methods of the present disclosure relate to reducing methylation of a target nucleic acid in a plant by recombinantly fusing a TET polypeptide (e.g. TET1 polypeptide) to a heterologous DNA-binding domain, where the DNA-binding domain is able to bind a specific nucleic acid sequence and thus the TET polypeptide (e.g. TET1 polypeptide) is targeted to the specific nucleic acid sequence. Certain methods of the present disclosure relate to reducing methylation of a target nucleic acid in a plant by targeting a TET polypeptide (e.g. TET1 polypeptide) recombinantly fused to a CAS9 protein to the target nucleic acid. Certain methods of the present disclosure relate to reducing methylation of a target nucleic acid in a plant by targeting a TET polypeptide (e.g. TET1 polypeptide) to a target nucleic acid with the assistance of a CAS9 protein. As used herein, a "polypeptide" is an amino acid sequence including a plurality of consecutive polymerized amino acid residues (e.g., at least about 15 consecutive polymerized amino acid residues). "Polypeptide" refers to an amino acid sequence, oligopeptide, peptide, protein, or portions thereof, and the terms "polypeptide" and "protein" are used interchangeably.

Polypeptides as described herein also include polypeptides having various amino acid additions, deletions, or substitutions relative to the native amino acid sequence of a polypeptide of the present disclosure. In some embodiments, polypeptides that are homologs of a polypeptide of the present disclosure contain non-conservative changes of certain amino acids relative to the native sequence of a polypeptide of the present disclosure. In some embodiments, polypeptides that are homologs of a polypeptide of the present disclosure contain conservative changes of certain amino acids relative to the native sequence of a polypeptide of the present disclosure, and thus may be referred to as conservatively modified variants. A conservatively modified variant may include individual substitutions, deletions or additions to a polypeptide sequence which result in the substitution of an amino acid with a chemically similar amino acid. Conservative substitution tables providing functionally similar amino acids are well-known in the art. Such conservatively modified variants are in addition to and do not exclude polymorphic variants, interspecies homologs, and alleles of the disclosure. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)). A modification of an amino acid to produce a chemically similar amino acid may be referred to as an analogous amino acid.

Recombinant polypeptides of the present disclosure that are composed of individual polypeptide domains may be described based on the individual polypeptide domains of the overall recombinant polypeptide. A domain in such a recombinant polypeptide refers to the particular stretches of contiguous amino acid sequences with a particular function or activity. For example, in a recombinant polypeptide that is a fusion of a TET polypeptide (e.g. TET1 polypeptide) and a DNA-binding domain, the contiguous amino acids that encode the TET polypeptide (e.g. TET1 polypeptide) may be described as the TET domain (e.g. TET1 domain) in the overall recombinant polypeptide, and the contiguous amino acids that encode the DNA-binding domain may be described as the DNA-binding domain in the overall recombinant polypeptide. Individual domains in an overall recombinant protein may also be referred to as units of the recombinant protein. Recombinant polypeptides that are composed of individual polypeptide domains may also be referred to as fusion polypeptides.

Fusion polypeptides of the present disclosure may contain an individual polypeptide domain that is in various N-terminal or C-terminal orientations relative to other individual polypeptide domains present in the fusion polypeptide. Fusion of individual polypeptide domains in fusion polypeptides may also be direct or indirect fusions. Direct fusions of individual polypeptide domains refer to direct fusion of the coding sequences of each respective individual polypeptide domain. In embodiments where the fusion is indirect, a linker domain or other contiguous amino acid sequence may separate the coding sequences of two individual polypeptide domains in a fusion polypeptide.

Nuclear Localization Signals (NLS)

Recombinant polypeptides of the present disclosure may contain one or more nuclear localization signals (NLS). Nuclear localization signals may also be referred to as nuclear localization sequences, domains, peptides, or other terms readily apparent to those of skill in the art. Nuclear localization signals are a translocation sequence that, when present in a polypeptide, direct that polypeptide to localize to the nucleus of a eukaryotic cell.

Various nuclear localization signals may be used in recombinant polypeptides of the present disclosure. For example, one or more SV40-type NLS or one or more REX NLS may be used in recombinant polypeptides. Recombinant polypeptides may also contain two or more tandem copies of a nuclear localization signal. For example, recombinant polypeptides may contain at least two, at least three, at least for, at least five, at least six, at least seven, at least eight, at least nine, or at least ten copies, either tandem or not, of a nuclear localization signal.

Recombinant polypeptides of the present disclosure may contain one or more nuclear localization signals that contain an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of any one of SEQ ID NO: 36, SEQ ID NO: 43, SEQ ID NO: 60, SEQ ID NO: 72, SEQ ID NO: 112, SEQ ID NO: 113, and/or SEQ ID NO: 127.

TET1 Proteins

Certain aspects of the present disclosure relate to TET1-like proteins. In some embodiments, a TET1-like protein refers to a recombinant TET1 protein or fragment thereof that contains a heterologous DNA-binding domain. In some embodiments, a TET1-like protein refers to a recombinant TET1 protein or fragment thereof that is fused to a CAS9 protein or fragment thereof. In some embodiments, a TET1-like protein refers to a recombinant TET1 protein or fragment thereof that is fused to an MS2 coat protein or fragment thereof. In some embodiments, a TET1-like protein refers to a recombinant TET1 protein or fragment thereof that is fused to an scFV antibody or fragment thereof. TET1-like proteins may be used in reducing methylation of one or more target nucleic acids, such as genes, in plants.

TET1 is an enzyme that catalyzes the conversion of 5-methylcytosine (5mC) to 5-hydroxymethylcytosine (5hmC) (Tahiliani, M. et al. Science 324, 930-935 (2009)). While the role of 5hmC is not entirely clear, it has been proposed that it may be an intermediate in the process of demethylation of 5-methylcytosine to cytosine. This is supported by evidence that overexpression of TET1 in cultured cells leads to an overall decrease in levels of 5mC (Tahiliani, M. et al. Science 324, 930-935 (2009)). Several mechanisms of demethylation have been proposed. There is evidence that 5hmC can be deaminated and that the resulting mismatched base is recognized by DNA glycosylases and subsequently repaired to cytosine via the base excision repair pathway (Guo et el., Cell 145, 423-434 (2011)). Alternatively, there is also evidence that iterative oxidation of 5hmC by TET1 yields 5-formylcytosine (fC) and 5-carboxylcytosine (caC), which can then be recognized by thymine DNA glycosylase and reverted to cytosine through base excision repair (He et al., Science 333, 1303-1307 (2011)). In either case, the evidence highlights TET1 as a primary catalyst for DNA demethylation.

In some embodiments, a TET1-like protein of the present disclosure includes a functional fragment of a full-length TET1 protein where the fragment maintains the ability to catalyze demethylation of a nucleic acid. In some embodiments, a TET1 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length TET1 protein. In some embodiments, TET1 protein fragments may include sequences with one or more amino acids removed from the consecutive amino acid sequence of a full-length TET1 protein. In some embodiments, TET1 protein fragments may include sequences with one or more amino acids replaced/substituted with an amino acid different from the endogenous amino acid present at a given amino acid position in a consecutive amino acid sequence of a full-length TET1 protein. In some embodiments, TET1 protein fragments may include sequences with one or more amino acids added to an otherwise consecutive amino acid sequence of a full-length TET1 protein.

Suitable TET1 proteins may be identified and isolated from various mammalian organisms. Examples of such organisms may include, for example, *Homo sapiens, Pan paniscus, Gorilla gorilla, Mandrillus leucophaeus, Equus caballus, Canis lupus familiaris*, and *Ovis aries*. Examples of suitable TET1 proteins may include, for example, those listed in Table 1, homologs thereof, and orthologs thereof.

TABLE 1

TET1 Proteins

| Organism | Gene Name | SED ID NO. |
|---|---|---|
| Homo sapiens | NP_085128 | 1 |
| Pan paniscus | XP_003846089.1 | 2 |
| Gorilla gorilla | XP_004049552.1 | 3 |
| Mandrillus leucophaeus | XP_011849484 | 4 |
| Equus caballus | XP_005602635 | 5 |
| Canis lupus familiaris | XP_536371 | 6 |
| Ovis aries | XP_011960588 | 7 |

In some embodiments, a TET1 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Homo sapiens* TET1 protein (SEQ ID NO: 1).

A TET1-like protein may include the amino acid sequence or a fragment thereof of any TET1 homolog or ortholog, such as any one of those listed in Table 1. One of skill would readily recognize that additional TET1 homologs and/or orthologs may exist and may be used herein.

In certain aspects, the catalytic domain of a TET1 protein may be used in the methods and compositions described herein. The catalytic domain of TET1 is responsible for facilitating demethylation of a nucleic acid. Examples of suitable TET1 catalytic domains may include, for example, those listed in Table 2, homologs thereof, and orthologs thereof.

TABLE 2

TET1 Protein Catalytic Domains

| Organism | Gene Name | SED ID NO. |
|---|---|---|
| Homo sapiens | NP_085128 | 8 |
| Pan paniscus | XP_003846089.1 | 9 |
| Gorilla gorilla | XP_004049552.1 | 10 |
| Mandrillus leucophaeus | XP_011849484 | 11 |
| Equus caballus | XP_005602635 | 12 |
| Canis lupus familiaris | XP_536371 | 13 |
| Ovis aries | XP_011960588 | 14 |

In some embodiments, a TET1 protein catalytic domain of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Homo sapiens* TET1 protein catalytic domain (SEQ ID NO: 8).

A TET1-like protein may include the amino acid sequence or a fragment thereof of the catalytic domain of any TET1 homolog or ortholog, such as any one of those listed in Table 2. One of skill would readily recognize that catalytic domains from additional TET1 homologs and/or orthologs may exist and may be used herein.

TET2 Proteins

Certain aspects of the present disclosure relate to TET2-like proteins. In some embodiments, a TET2-like protein refers to a recombinant TET2 protein or fragment thereof that contains a heterologous DNA-binding domain. In some embodiments, a TET2-like protein refers to a recombinant TET2 protein or fragment thereof that is fused to a CAS9 protein or fragment thereof. In some embodiments, a TET2-like protein refers to a recombinant TET2 protein or fragment thereof that is fused to an MS2 coat protein or fragment thereof. In some embodiments, a TET2-like protein refers to a recombinant TET2 protein or fragment thereof that is fused to an scFV antibody or fragment thereof. TET2-like proteins may be used in reducing methylation of one or more target nucleic acids, such as genes, in plants.

In some embodiments, a TET2-like protein of the present disclosure includes a functional fragment of a full-length TET2 protein where the fragment maintains the ability to catalyze demethylation of a nucleic acid. In some embodiments, a TET2 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length TET2 protein. In some embodiments, TET2 protein fragments may include sequences with one or more amino acids removed from the consecutive amino acid sequence of a full-length TET2 protein. In some embodiments, TET2 protein fragments may include sequences with one or more amino acids replaced/substituted with an amino acid different from the endogenous amino acid present at a given amino acid position in a consecutive amino acid sequence of a full-length TET2 protein. In some embodiments, TET2 protein fragments may include sequences with one or more amino acids added to an otherwise consecutive amino acid sequence of a full-length TET2 protein.

Suitable TET2 proteins may be identified and isolated from various mammalian organisms. The amino acid sequence of human TET2 protein is set forth in SEQ ID NO: 191.

In some embodiments, a TET2 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Homo sapiens* TET2 protein (SEQ ID NO: 191).

In certain aspects, the catalytic domain of a TET2 protein may be used in the methods and compositions described herein. The catalytic domain of TET2 is responsible for facilitating demethylation of a nucleic acid. The amino acid sequence of the catalytic domain of human TET2 protein is set forth in SEQ ID NO: 192.

In some embodiments, a TET2 protein catalytic domain of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Homo sapiens* TET2 protein catalytic domain (SEQ ID NO: 192).

A TET2-like protein may include the amino acid sequence or a fragment thereof of the catalytic domain of any TET2 homolog or ortholog. One of skill would readily recognize that catalytic domains from additional TET2 homologs and/or orthologs may exist and may be used herein.

TET3 Proteins

Certain aspects of the present disclosure relate to TET3-like proteins. In some embodiments, a TET3-like protein refers to a recombinant TET3 protein or fragment thereof that contains a heterologous DNA-binding domain. In some embodiments, a TET3-like protein refers to a recombinant TET3 protein or fragment thereof that is fused to a CAS9 protein or fragment thereof. In some embodiments, a TET3-like protein refers to a recombinant TET3 protein or fragment thereof that is fused to an MS2 coat protein or fragment thereof. In some embodiments, a TET3-like protein refers to a recombinant TET3 protein or fragment thereof that is fused to an scFV antibody or fragment thereof. TET3-like proteins may be used in reducing methylation of one or more target nucleic acids, such as genes, in plants.

In some embodiments, a TET3-like protein of the present disclosure includes a functional fragment of a full-length TET3 protein where the fragment maintains the ability to catalyze demethylation of a nucleic acid. In some embodiments, a TET3 protein fragment contains at least 20 consecutive amino acids, at least 30 consecutive amino acids, at least 40 consecutive amino acids, at least 50 consecutive amino acids, at least 60 consecutive amino acids, at least 70 consecutive amino acids, at least 80 consecutive amino acids, at least 90 consecutive amino acids, at least 100 consecutive amino acids, at least 120 consecutive amino acids, at least 140 consecutive amino acids, at least 160 consecutive amino acids, at least 180 consecutive amino acids, at least 200 consecutive amino acids, at least 220 consecutive amino acids, at least 240 consecutive amino acids, or 241 or more consecutive amino acids of a full-length TET3 protein. In some embodiments, TET3 protein fragments may include sequences with one or more amino acids removed from the consecutive amino acid sequence of a full-length TET3 protein. In some embodiments, TET3 protein fragments may include sequences with one or more amino acids replaced/substituted with an amino acid different from the endogenous amino acid present at a given amino acid position in a consecutive amino acid sequence of a full-length TET3 protein. In some embodiments, TET3 protein fragments may include sequences with one or more amino acids added to an otherwise consecutive amino acid sequence of a full-length TET3 protein.

Suitable TET3 proteins may be identified and isolated from various mammalian organisms. The amino acid sequence of human TET3 protein is set forth in SEQ ID NO: 193.

In some embodiments, a TET3 protein or fragment thereof of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Homo sapiens* TET3 protein (SEQ ID NO: 193).

In certain aspects, the catalytic domain of a TET3 protein may be used in the methods and compositions described herein. The catalytic domain of TET3 is responsible for facilitating demethylation of a nucleic acid. The amino acid sequence of the catalytic domain of human TET3 protein is set forth in SEQ ID NO: 194.

In some embodiments, a TET3 protein catalytic domain of the present disclosure has an amino acid sequence with at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% amino acid identity to the amino acid sequence of the *Homo sapiens* TET3 protein catalytic domain (SEQ ID NO: 194).

A TET3-like protein may include the amino acid sequence or a fragment thereof of the catalytic domain of any TET3 homolog or ortholog. One of skill would readily recognize that catalytic domains from additional TET3 homologs and/or orthologs may exist and may be used herein.

Recombinant Nucleic Acids Encoding Recombinant Proteins

Certain aspects of the present disclosure relate to recombinant nucleic acids encoding recombinant proteins of the present disclosure (e.g. TET-like proteins, such as TET1-like proteins). In some embodiments, a TET-like protein (e.g. TET1-like protein) is a recombinant TET protein (e.g. TET1 protein) or fragment thereof that contains a heterologous DNA-binding domain. In some embodiments, a TET-like protein (e.g. TET1-like protein) is a recombinant TET protein (e.g. TET1 protein) or fragment thereof that is fused to a CAS9 protein or fragment thereof. In some embodiments, a TET-like protein (e.g. TET1-like protein) is a recombinant TET protein (e.g. TET1 protein) or fragment thereof that is fused to an MS2 coat protein or fragment thereof. In some embodiments, a TET-like protein (e.g. TET1-like protein) is a recombinant TET protein (e.g. TET1 protein) or fragment thereof that is fused to an scFV antibody or fragment thereof.

As used herein, the terms "polynucleotide," "nucleic acid," and variations thereof shall be generic to polydeoxyribonucleotides (containing 2-deoxy-D-ribose), to polyribonucleotides (containing D-ribose), to any other type of polynucleotide that is an N-glycoside of a purine or pyrimidine base, and to other polymers containing non-nucleotidic backbones, provided that the polymers contain nucleobases in a configuration that allows for base pairing and base stacking, as found in DNA and RNA. Thus, these terms include known types of nucleic acid sequence modifications, for example, substitution of one or more of the naturally occurring nucleotides with an analog, and inter-nucleotide modifications. As used herein, the symbols for nucleotides and polynucleotides are those recommended by the IUPAC-IUB Commission of Biochemical Nomenclature.

In one aspect, the present disclosure provides a recombinant nucleic acid encoding a TET1-like protein. In some embodiments, the recombinant nucleic acid encodes a TET1 polypeptide or fragment thereof that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 1.

In one aspect, the present disclosure provides a recombinant nucleic acid encoding a TET1-like protein. In some embodiments, the recombinant nucleic acid encodes a catalytic domain of a TET1 protein that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 8.

In one aspect, the present disclosure provides a recombinant nucleic acid encoding a TET2-like protein. In some embodiments, the recombinant nucleic acid encodes a catalytic domain of a TET2 protein that has an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or 100% identical to SEQ ID NO: 192.

In one aspect, the present disclosure provides a recombinant nucleic acid encoding a TET3-like protein. In some embodiments, the recombinant nucleic acid encodes a catalytic domain of a TET3 protein that has an amino acid sequence that is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, or 100% identical to SEQ ID NO: 194.

Sequences of the polynucleotides of the present disclosure may be prepared by various suitable methods known in the art, including, for example, direct chemical synthesis or cloning. For direct chemical synthesis, formation of a polymer of nucleic acids typically involves sequential addition of 3'-blocked and 5'-blocked nucleotide monomers to the terminal 5'-hydroxyl group of a growing nucleotide chain, wherein each addition is effected by nucleophilic attack of the terminal 5'-hydroxyl group of the growing chain on the 3'-position of the added monomer, which is typically a phosphorus derivative, such as a phosphotriester, phosphoramidite, or the like. Such methodology is known to those of ordinary skill in the art and is described in the pertinent texts and literature (e.g., in Matteucci et al., (1980) Tetrahedron Lett 21:719-722; U.S. Pat. Nos. 4,500,707; 5,436,327; and 5,700,637). In addition, the desired sequences may be isolated from natural sources by splitting DNA using appropriate restriction enzymes, separating the fragments using gel electrophoresis, and thereafter, recovering the desired polynucleotide sequence from the gel via techniques known to those of ordinary skill in the art, such as utilization of polymerase chain reactions (PCR; e.g., U.S. Pat. No. 4,683,195).

The nucleic acids employed in the methods and compositions described herein may be codon optimized relative to a parental template for expression in a particular host cell. Cells differ in their usage of particular codons, and codon bias corresponds to relative abundance of particular tRNAs in a given cell type. By altering codons in a sequence so that they are tailored to match with the relative abundance of corresponding tRNAs, it is possible to increase expression of a product (e.g. a polypeptide) from a nucleic acid. Similarly, it is possible to decrease expression by deliberately choosing codons corresponding to rare tRNAs. Thus, codon optimization/deoptimization can provide control over nucleic acid expression in a particular cell type (e.g. bacterial cell, plant cell, mammalian cell, etc.). Methods of codon optimizing a nucleic acid for tailored expression in a particular cell type are well-known to those of skill in the art.

Methods of Identifying Sequence Similarity

Various methods are known to those of skill in the art for identifying similar (e.g. homologs, orthologs, paralogs, etc.) polypeptide and/or polynucleotide sequences, including phylogenetic methods, sequence similarity analysis, and hybridization methods.

Phylogenetic trees may be created for a gene family by using a program such as CLUSTAL (Thompson et al. Nucleic Acids Res. 22: 4673-4680 (1994); Higgins et al. *Methods Enzymol* 266: 383-402 (1996)) or MEGA (Tamura et al. *Mol. Biol. & Evo.* 24:1596-1599 (2007)). Once an initial tree for genes from one species is created, potential orthologous sequences can be placed in the phylogenetic tree and their relationships to genes from the species of interest can be determined. Evolutionary relationships may also be inferred using the Neighbor-Joining method (Saitou and Nei, *Mol. Biol. & Evo.* 4:406-425 (1987)). Homologous sequences may also be identified by a reciprocal BLAST strategy. Evolutionary distances may be computed using the Poisson correction method (Zuckerkandl and Pauling, pp. 97-166 in *Evolving Genes and Proteins*, edited by V. Bryson and H. J. Vogel. Academic Press, New York (1965)).

In addition, evolutionary information may be used to predict gene function. Functional predictions of genes can be greatly improved by focusing on how genes became similar in sequence (i.e. by evolutionary processes) rather than on the sequence similarity itself (Eisen, *Genome Res.* 8: 163-167 (1998)). Many specific examples exist in which gene function has been shown to correlate well with gene phylogeny (Eisen, *Genome Res.* 8: 163-167 (1998)). By using a phylogenetic analysis, one skilled in the art would recognize that the ability to deduce similar functions conferred by closely-related polypeptides is predictable.

When a group of related sequences are analyzed using a phylogenetic program such as CLUSTAL, closely related sequences typically cluster together or in the same Glade (a group of similar genes). Groups of similar genes can also be identified with pair-wise BLAST analysis (Feng and Doolittle, *J. Mol. Evol.* 25: 351-360 (1987)). Analysis of groups of similar genes with similar function that fall within one Glade can yield sub-sequences that are particular to the Glade. These sub-sequences, known as consensus sequences, can not only be used to define the sequences within each Glade, but define the functions of these genes; genes within a Glade may contain paralogous sequences, or orthologous sequences that share the same function (see also, for example, Mount, Bioinformatics: Sequence and Genome Analysis Cold Spring Harbor Laboratory Press, Cold Spring Harbor, N.Y., page 543 (2001)).

To find sequences that are homologous to a reference sequence, BLAST nucleotide searches can be performed with the BLASTN program, score=100, wordlength=12, to obtain nucleotide sequences homologous to a nucleotide sequence encoding a protein of the disclosure. BLAST protein searches can be performed with the BLASTX program, score=50, wordlength=3, to obtain amino acid sequences homologous to a protein or polypeptide of the disclosure. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, or PSI-BLAST, the default parameters of the respective programs (e.g., BLASTN for nucleotide sequences, BLASTX for proteins) can be used.

Methods for the alignment of sequences and for the analysis of similarity and identity of polypeptide and polynucleotide sequences are well-known in the art.

As used herein "sequence identity" refers to the percentage of residues that are identical in the same positions in the sequences being analyzed. As used herein "sequence similarity" refers to the percentage of residues that have similar biophysical/biochemical characteristics in the same positions (e.g. charge, size, hydrophobicity) in the sequences being analyzed.

Methods of alignment of sequences for comparison are well-known in the art, including manual alignment and computer assisted sequence alignment and analysis. This latter approach is a preferred approach in the present disclosure, due to the increased throughput afforded by computer assisted methods. As noted below, a variety of computer programs for performing sequence alignment are available, or can be produced by one of skill.

The determination of percent sequence identity and/or similarity between any two sequences can be accomplished using a mathematical algorithm. Examples of such mathematical algorithms are the algorithm of Myers and Miller, CABIOS 4:11-17 (1988); the local homology algorithm of Smith et al., Adv. Appl. Math. 2:482 (1981); the homology alignment algorithm of Needleman and Wunsch, J. Mol. Biol. 48:443-453 (1970); the search-for-similarity-method of Pearson and Lipman, Proc. Natl. Acad. Sci. 85:2444-2448 (1988); the algorithm of Karlin and Altschul, Proc. Natl. Acad. Sci. USA 87:2264-2268 (1990), modified as in Karlin and Altschul, Proc. Natl. Acad. Sci. USA 90:5873-5877 (1993).

Computer implementations of these mathematical algorithms can be utilized for comparison of sequences to determine sequence identity and/or similarity. Such implementations include, for example: CLUSTAL in the PC/Gene program (available from Intelligenetics, Mountain View, Calif.); the AlignX program, version10.3.0 (Invitrogen, Carlsbad, Calif.) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described by Higgins et al. Gene 73:237-244 (1988); Higgins et al. CABIOS 5:151-153 (1989); Corpet et al., Nucleic Acids Res. 16:10881-90 (1988); Huang et al. CABIOS 8:155-65 (1992); and Pearson et al., Meth. Mol. Biol. 24:307-331 (1994). The BLAST programs of Altschul et al. J. Mol. Biol. 215:403-410 (1990) are based on the algorithm of Karlin and Altschul (1990) supra.

Polynucleotides homologous to a reference sequence can be identified by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in references cited below (e.g., Sambrook et al., Molecular Cloning: A Laboratory Manual, 2nd Ed., Vol. 1-3, Cold Spring Harbor Laboratory, Cold Spring Harbor, N.Y. ("Sambrook") (1989); Berger and Kimmel, Guide to Molecular Cloning Techniques, Methods in Enzymology, vol. 152 Academic Press, Inc., San Diego, Calif. ("Berger and Kimmel") (1987); and Anderson and Young, "Quantitative Filter Hybridisation." In: Hames and Higgins, ed., Nucleic Acid Hybridisation, A Practical Approach. Oxford, TRL Press, 73-111 (1985)).

Encompassed by the disclosure are polynucleotide sequences that are capable of hybridizing to the disclosed polynucleotide sequences and fragments thereof under various conditions of stringency (see, for example, Wahl and Berger, Methods Enzymol. 152: 399-407 (1987); and Kimmel, Methods Enzymo. 152: 507-511, (1987)). Full length cDNA, homologs, orthologs, and paralogs of polynucleotides of the present disclosure may be identified and isolated using well-known polynucleotide hybridization methods.

With regard to hybridization, conditions that are highly stringent, and means for achieving them, are well known in the art. See, for example, Sambrook et al. (1989) (supra); Berger and Kimmel (1987) pp. 467-469 (supra); and Anderson and Young (1985)(supra).

Hybridization experiments are generally conducted in a buffer of pH between 6.8 to 7.4, although the rate of hybridization is nearly independent of pH at ionic strengths likely to be used in the hybridization buffer (Anderson and Young (1985)(supra)). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency. As a general guideline, high stringency is typically performed at $T_m$–5°

C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH.

Hybridization and wash conditions that may be used to bind and remove polynucleotides with less than the desired homology to the nucleic acid sequences or their complements of the present disclosure include, for example: 6×SSC and 1% SDS at 65° C.; 50% formamide, 4×SSC at 42° C.; 0.5×SSC to 2.0×SSC, 0.1% SDS at 50° C. to 65° C.; or 0.1×SSC to 2×SSC, 0.1% SDS at 50° C.-65° C.; with a first wash step of, for example, 10 minutes at about 42° C. with about 20% (v/v) formamide in 0.1×SSC, and with, for example, a subsequent wash step with 0.2×SSC and 0.1% SDS at 65° C. for 10, 20 or 30 minutes.

For identification of less closely related homologs, wash steps may be performed at a lower temperature, e.g., 50° C. An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Wash procedures will generally employ at least two final wash steps. Additional variations on these conditions will be readily apparent to those skilled in the art (see, for example, US Patent Application No. 20010010913).

If desired, one may employ wash steps of even greater stringency, including conditions of 65° C.-68° C. in a solution of 15 mM NaCl, 1.5 mM trisodium citrate, and 0.1% SDS, or about 0.2×SSC, 0.1% SDS at 65° C. and washing twice, each wash step of 10, 20 or 30 min in duration, or about 0.1×SSC, 0.1% SDS at 65° C. and washing twice for 10, 20 or 30 min. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C.

Target Nucleic Acids of the Present Disclosure

The recombinant TET-like proteins (e.g. TET1-like proteins) of the present disclosure may be targeted to specific target nucleic acids to induce demethylation of the target nucleic acid. In some embodiments, TET-like proteins (e.g. TET1-like proteins) are targeted to a specific nucleic acid via a heterologous DNA-binding domain. In some embodiments, TET-like proteins (e.g. TET1-like proteins) reduce methylation of a target nucleic acid by being targeted to the nucleic acid by a guide RNA. In this sense, a target nucleic acid of the present disclosure is targeted based on the particular nucleotide sequence in the target nucleic acid that is recognized by the targeting portion of a TET-like polypeptide such as a TET1-like polypeptide (e.g. DNA-binding domain or guide RNA).

In some embodiments, a target nucleic acid of the present disclosure is a nucleic acid that is located at any location within a target gene that provides a suitable location for reducing methylation of the target gene. The target nucleic acid may be located within the coding region of a target gene or upstream or downstream thereof. Moreover, the target nucleic acid may reside endogenously in a target gene or may be inserted into the gene, e.g., heterologous, for example, using techniques such as homologous recombination. For example, a target gene of the present disclosure can be operably linked to a control region, such as a promoter, that contains a sequence that can be recognized by e.g. a crRNA/tracrRNA and/or a guide RNA of the present disclosure such that recombinant TET-like proteins (e.g. TET1-like proteins) of the present disclosure are targeted to that sequence. Also, the target nucleic acid may be one that is able to be bound by a DNA-binding domain that is recombinantly fused to a TET-like protein (e.g. TET1-like protein) of the present disclosure.

In some embodiments, the target nucleic acid is endogenous to the plant where the expression of one or more genes is modulated by a TET-like protein (e.g. TET1-like protein) as a result of reduced methylation at the target nucleic acid as facilitated by the TET-like protein (e.g. TET1-like protein). In some embodiments, the target nucleic acid is a transgene of interest that has been inserted into a plant. Methods of introducing transgenes into plants are well known in the art. Transgenes may be inserted into plants in order to provide a production system for a desired protein, or may be added to the genetic compliment in order to modulate the metabolism of a plant. In some embodiments, the expression of a target nucleic acid is increased as a consequence of the methods of the present disclosure using TET-like proteins (e.g. TET1-like proteins).

Suitable target nucleic acids will be readily apparent to one of skill in the art depending on the particular need or outcome. The target nucleic acid may be in e.g. a region of euchromatin (e.g. highly expressed gene), or the target nucleic acid may be in a region of heterochromatin (e.g. centromere DNA). Use of TET-like proteins (e.g. TET1-like proteins) as described herein to target demethylation and transcript activation in a region of heterochromatin or other highly methylated region of a plant genome may be especially useful in certain research embodiments. For example, use of TET1-like proteins to demethylate and activate a retrotransposon in a plant genome may find use in inducing mutagenesis of other genomic regions in that genome.

In some embodiments, a target nucleic acid may have its expression downregulated/reduced, or silenced, by a TET-like protein (e.g. TET1-like protein) according to the methods of the present disclosure. The particular nature of the target nucleic acid, and the role that methylation of that nucleic acid plays with respect to expression of that target nucleic acid, are factors that may govern whether a particular target nucleic acid may have its expression increased or decreased as compared to a corresponding control nucleic acid according to the methods of the present disclosure. Reduction in methylation of a target nucleic acid may lead to increased expression, or reduction in methylation may lead to decreased expression, as compared to a corresponding control.

Plants of the Present Disclosure

Certain aspects of the present disclosure relate to plants containing TET-like proteins (e.g. TET1-like proteins) that are targeted to one or more target nucleic acids in the plant and reduce the methylation level of the one or more target nucleic acids.

As used herein, a "plant" refers to any of various photosynthetic, eukaryotic multi-cellular organisms of the kingdom Plantae, characteristically producing embryos, containing chloroplasts, having cellulose cell walls and lacking locomotion. As used herein, a "plant" includes any plant or part of a plant at any stage of development, including seeds, suspension cultures, plant cells, embryos, meristematic regions, callus tissue, leaves, roots, shoots, gametophytes, sporophytes, pollen, microspores, and progeny thereof. Also included are cuttings, and cell or tissue cultures. As used in conjunction with the present disclosure, plant tissue includes, for example, whole plants, plant cells, plant organs, e.g., leafs, stems, roots, meristems, plant seeds, protoplasts, callus, cell cultures, and any groups of plant cells organized into structural and/or functional units.

Any plant cell may be used in the present disclosure so long as it remains viable after being transformed with a sequence of nucleic acids. Preferably, the plant cell is not adversely affected by the transduction of the necessary nucleic acid sequences, the subsequent expression of the proteins or the resulting intermediates.

As disclosed herein, a broad range of plant types may be modified to incorporate an TET1-like protein of the present disclosure. Suitable plants that may be modified include both monocotyledonous (monocot) plants and dicotyledonous (dicot) plants.

Examples of suitable plants may include, for example, species of the Family Gramineae, including *Sorghum bicolor* and *Zea mays*; species of the genera: *Cucurbita, Rosa, Vitis, Juglans, Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browaalia, Glycine, Pisum, Phaseolus, Lolium, Oryza, Avena, Hordeum, Secale*, and *Triticum*.

In some embodiments, plant cells may include, for example, those from corn (*Zea mays*), canola (*Brassica napus, Brassica rapa* ssp.), *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (Carthamus tinctorius), wheat (*Triticum aestivum*), duckweed (*Lemna*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucijra*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia* spp.), almond (*Prunus amygdalus*), sugar beets (*Beta vulgaris*), sugarcane (*Saccharum* spp.), oats, barley, vegetables, ornamentals, and conifers.

Examples of suitable vegetables plants may include, for example, tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*).

Examples of suitable ornamental plants may include, for example, azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (Euphorbiapulcherrima), and *chrysanthemum*.

Examples of suitable conifer plants may include, for example, loblolly pine (*Pinus taeda*), slash pine (*Pinus elliotii*), *ponderosa* pine (*Pinus ponderosa*), lodgepole pine (*Pinus contorta*), Monterey pine (*Pinus radiata*), Douglas-fir (*Pseudotsuga menziesii*), Western hemlock (*Isuga canadensis*), Sitka spruce (*Picea glauca*), redwood (*Sequoia sempervirens*), silver fir (*Abies amabilis*), balsam fir (*Abies balsamea*), Western red cedar (*Thuja plicata*), and Alaska yellow-cedar (*Chamaecyparis nootkatensis*).

Examples of suitable leguminous plants may include, for example, guar, locust bean, fenugreek, soybean, garden beans, cowpea, mungbean, lima bean, fava bean, lentils, chickpea, peanuts (*Arachis* sp.), crown vetch (*Vicia* sp.), hairy vetch, adzuki bean, lupine (*Lupinus* sp.), *trifolium*, common bean (*Phaseolus* sp.), field bean (*Pisum* sp.), clover (*Melilotus* sp.) Lotus, trefoil, lens, and false indigo.

Examples of suitable forage and turf grass may include, for example, alfalfa (*Medicago* s sp.), orchard grass, tall fescue, perennial ryegrass, creeping bent grass, and redtop.

Examples of suitable crop plants and model plants may include, for example, *Arabidopsis*, corn, rice, alfalfa, sunflower, canola, soybean, cotton, peanut, sorghum, wheat, tobacco, and *lemna*.

The plants of the present disclosure may be genetically modified in that recombinant nucleic acids have been introduced into the plants, and as such the genetically modified plants do not occur in nature. A suitable plant of the present disclosure is one capable of expressing one or more nucleic acid constructs encoding one or more recombinant proteins. The recombinant proteins encoded by the nucleic acids may be e.g. TET1-like proteins.

As used herein, the terms "transgenic plant" and "genetically modified plant" are used interchangeably and refer to a plant which contains within its genome a recombinant nucleic acid. Generally, the recombinant nucleic acid is stably integrated within the genome such that the polynucleotide is passed on to successive generations. However, in certain embodiments, the recombinant nucleic acid is transiently expressed in the plant. The recombinant nucleic acid may be integrated into the genome alone or as part of a recombinant expression cassette. "Transgenic" is used herein to include any cell, cell line, callus, tissue, plant part or plant, the genotype of which has been altered by the presence of exogenous nucleic acid including those transgenics initially so altered as well as those created by sexual crosses or asexual propagation from the initial transgenic.

"Recombinant nucleic acid" or "heterologous nucleic acid" or "recombinant polynucleotide" as used herein refers to a polymer of nucleic acids wherein at least one of the following is true: (a) the sequence of nucleic acids is foreign to (i.e., not naturally found in) a given host cell; (b) the sequence may be naturally found in a given host cell, but in an unnatural (e.g., greater than expected) amount; or (c) the sequence of nucleic acids contains two or more subsequences that are not found in the same relationship to each other in nature. For example, regarding instance (c), a recombinant nucleic acid sequence will have two or more sequences from unrelated genes arranged to make a new functional nucleic acid. Specifically, the present disclosure describes the introduction of an expression vector into a plant cell, where the expression vector contains a nucleic acid sequence coding for a protein that is not normally found in a plant cell or contains a nucleic acid coding for a protein that is normally found in a plant cell but is under the control of different regulatory sequences. With reference to the plant cell's genome, then, the nucleic acid sequence that codes for the protein is recombinant. A protein that is referred to as recombinant generally implies that it is encoded by a recombinant nucleic acid sequence which may be present in the plant cell. Recombinant proteins of the present disclosure may also be exogenously supplied directly to host cells (e.g. plant cells).

A "recombinant" polypeptide, protein, or enzyme of the present disclosure, is a polypeptide, protein, or enzyme that is encoded by a "recombinant nucleic acid" or "heterologous nucleic acid" or "recombinant polynucleotide."

In some embodiments, the genes encoding the recombinant proteins in the plant cell may be heterologous to the plant cell. In certain embodiments, the plant cell does not naturally produce the recombinant proteins, and contains heterologous nucleic acid constructs capable of expressing one or more genes necessary for producing those molecules. In certain embodiments, the plant cell does not naturally produce one or more polypeptides of the present disclosure, and is provided the one or more polypeptides through exogenous delivery of the polypeptides directly to the plant cell without the need to express a recombinant nucleic acid encoding the recombinant polypeptide in the plant cell.

Recombinant nucleic acids and/or recombinant proteins of the present disclosure may be present in host cells (e.g. plant cells). In some embodiments, recombinant nucleic acids are present in an expression vector, and the expression vector may be present in host cells (e.g. plant cells).

Expression of Recombinant Proteins in Plants

A TET-like protein (e.g. TET1-like protein) of the present disclosure may be introduced into plant cells via any suitable methods known in the art. For example, a TET-like protein (e.g. TET1-like protein) can be exogenously added to plant cells and the plant cells are maintained under conditions such that the TET-like protein (e.g. TET1-like protein) is targeted to one or more target nucleic acids and reduces the methylation of the target nucleic acids in the plant cells. Alternatively, a recombinant nucleic acid encoding a TET-like protein (e.g. TET1-like protein) of the present disclosure can be expressed in plant cells and the plant cells are maintained under conditions such that the TET-like protein (e.g. TET1-like protein) of the present disclosure is targeted to one or more target nucleic acids and reduces the methylation of the target gene in the plant cells. Additionally, in some embodiments, a TET-like protein (e.g. TET1-like protein) of the present disclosure may be transiently expressed in a plant via viral infection of the plant, or by introducing a TET-like (e.g. TET1-like) protein-encoding RNA into a plant to reduce the methylation of a target nucleic acid of interest. Methods of introducing recombinant proteins via viral infection or via the introduction of RNAs into plants are well known in the art. For example, Tobacco rattle virus (TRV) has been successfully used to introduce zinc finger nucleases in plants to cause genome modification ("Nontransgenic Genome Modification in Plant Cells", Plant Physiology 154:1079-1087 (2010)).

A recombinant nucleic acid encoding a TET-like protein (e.g. TET1-like protein) of the present disclosure can be expressed in a plant with any suitable plant expression vector. Typical vectors useful for expression of recombinant nucleic acids in higher plants are well known in the art and include, for example, vectors derived from the tumor-inducing (Ti) plasmid of *Agrobacterium tumefaciens* (e.g., see Rogers et al., Meth. in Enzymol. (1987) 153:253-277). These vectors are plant integrating vectors in that on transformation, the vectors integrate a portion of vector DNA into the genome of the host plant. Exemplary *A. tumefaciens* vectors useful herein are plasmids pKYLX6 and pKYLX7 (e.g., see of Schardl et al., Gene (1987) 61:1-11; and Berger et al., Proc. Natl. Acad. Sci. USA (1989) 86:8402-8406); and plasmid pBI 101.2 that is available from Clontech Laboratories, Inc. (Palo Alto, Calif.).

In addition to regulatory domains, a TET-like protein (e.g. TET1-like protein) of the present disclosure can be expressed as a fusion protein that is coupled to, for example, a maltose binding protein ("MBP"), glutathione S transferase (GST), hexahistidine, c-myc, or the FLAG epitope for ease of purification, monitoring expression, or monitoring cellular and subcellular localization.

Moreover, a recombinant nucleic acid encoding a TET-like protein (e.g. TET1-like protein) of the present disclosure can be modified to improve expression of the recombinant protein in plants by using codon preference. When the recombinant nucleic acid is prepared or altered synthetically, advantage can be taken of known codon preferences of the intended plant host where the nucleic acid is to be expressed. For example, recombinant nucleic acids of the present disclosure can be modified to account for the specific codon preferences and GC content preferences of monocotyledons and dicotyledons, as these preferences have been shown to differ (Murray et al., Nucl. Acids Res. (1989) 17: 477-498).

In some embodiments, a TET-like protein (e.g. TET1-like protein) of the present disclosure can be used to create functional "overexpression" mutations in a plant by releasing repression of the target gene expression as a consequence of the reduced methylation of the target nucleic acid. Release of gene expression repression, which may lead to activation of gene expression, may be of a structural gene, e.g., one encoding a protein having for example enzymatic activity, or of a regulatory gene, e.g., one encoding a protein that in turn regulates expression of a structural gene.

The present disclosure further provides expression vectors encoding TET-like proteins (e.g. TET1-like proteins). A nucleic acid sequence coding for the desired recombinant nucleic acid of the present disclosure can be used to construct a recombinant expression vector which can be introduced into the desired host cell. A recombinant expression vector will typically contain a nucleic acid encoding a recombinant protein of the present disclosure, operably linked to transcriptional initiation regulatory sequences which will direct the transcription of the nucleic acid in the intended host cell, such as tissues of a transformed plant.

For example, plant expression vectors may include (1) a cloned gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter, or functional fragment thereof, can be employed to control the expression of a recombinant nucleic acid of the present disclosure in regenerated plants. The selection of the promoter used in expression vectors will determine the spatial and temporal expression pattern of the recombinant nucleic acid in the modified plant, e.g., the nucleic acid encoding the TET-like protein (e.g. TET1-like protein) of the present disclosure is only expressed in the desired tissue or at a certain time in plant development or growth. Certain promoters will express recombinant nucleic acids in all plant tissues and are active under most environmental conditions and states of development or cell differentiation (i.e., constitutive promoters). Other promoters will express recombinant nucleic acids in specific cell types (such as leaf epidermal cells, mesophyll cells, root cortex cells) or in specific tissues or organs (roots, leaves or flowers, for example) and the selection will reflect the desired location of accumulation of the gene product. Alternatively, the selected promoter may drive expression of the recombinant nucleic acid under various inducing conditions.

Examples of suitable constitutive promoters may include, for example, the core promoter of the Rsyn7, the core CaMV 35S promoter (Odell et al., Nature (1985) 313:810-812), CaMV 19S (Lawton et al., 1987), rice actin (Wang et al., 1992; U.S. Pat. No. 5,641,876; and McElroy et al., Plant Cell (1985) 2:163-171); ubiquitin (Christensen et al., Plant Mol. Biol. (1989)12:619-632; and Christensen et al., *Plant Mol. Biol.* (1992) 18:675-689), pEMU (Last et al., Theor. Appl. Genet. (1991) 81:581-588), MAS (Velten et al., EMBO J. (1984) 3:2723-2730), nos (Ebert et al., 1987), Adh (Walker et al., 1987), the P- or 2'-promoter derived from T-DNA of *Agrobacterium tumefaciens*, the Smas promoter, the cinnamyl alcohol dehydrogenase promoter (U.S. Pat. No. 5,683,439), the Nos promoter, the pEmu promoter, the rubisco promoter, the GRP 1-8 promoter, and other transcription initiation regions from various plant genes known to those of skilled artisans, and constitutive promoters described in, for example, U.S. Pat. Nos. 5,608,149; 5,608, 144; 5,604,121; 5,569,597; 5,466,785; 5,399,680; 5,268, 463; and 5, 608,142. In some embodiments, expression of a nucleic acid of the present disclosure (e.g. a nucleic acid encoding a TET1-like protein) may be driven (in operable linkage) with a UBQ10 promoter.

Examples of suitable tissue specific promoters may include, for example, the lectin promoter (Vodkin et al., 1983; Lindstrom et al., 1990), the corn alcohol dehydrogenase 1 promoter (Vogel et al., 1989; Dennis et al., 1984), the corn light harvesting complex promoter (Simpson, 1986; Bansal et al., 1992), the corn heat shock protein promoter (Odell et al., Nature (1985) 313:810-812; Rochester et al., 1986), the pea small subunit RuBP carboxylase promoter (Poulsen et al., 1986; Cashmore et al., 1983), the Ti plasmid mannopine synthase promoter (Langridge et al., 1989), the Ti plasmid nopaline synthase promoter (Langridge et al., 1989), the *petunia* chalcone isomerase promoter (Van Tunen et al., 1988), the bean glycine rich protein 1 promoter (Keller et al., 1989), the truncated CaMV 35s promoter (Odell et al., Nature (1985) 313:810-812), the potato patatin promoter (Wenzler et al., 1989), the root cell promoter (Conkling et al., 1990), the maize zein promoter (Reina et al., 1990; Kriz et al., 1987; Wandelt and Feix, 1989; Langridge and Feix, 1983; Reina et al., 1990), the globulin-1 promoter (Belanger and Kriz et al., 1991), the α-tubulin promoter, the cab promoter (Sullivan et al., 1989), the PEPCase promoter (Hudspeth & Grula, 1989), the R gene complex-associated promoters (Chandler et al., 1989), and the chalcone synthase promoters (Franken et al., 1991).

Alternatively, the plant promoter can direct expression of a recombinant nucleic acid of the present disclosure in a specific tissue or may be otherwise under more precise environmental or developmental control. Such promoters are referred to here as "inducible" promoters. Environmental conditions that may affect transcription by inducible promoters include, for example, pathogen attack, anaerobic conditions, or the presence of light. Examples of inducible promoters include, for example, the AdhI promoter which is inducible by hypoxia or cold stress, the Hsp70 promoter which is inducible by heat stress, and the PPDK promoter which is inducible by light. Examples of promoters under developmental control include, for example, promoters that initiate transcription only, or preferentially, in certain tissues, such as leaves, roots, fruit, seeds, or flowers. An exemplary promoter is the anther specific promoter 5126 (U.S. Pat. Nos. 5,689,049 and 5,689,051). The operation of a promoter may also vary depending on its location in the genome. Thus, an inducible promoter may become fully or partially constitutive in certain locations.

Moreover, any combination of a constitutive or inducible promoter, and a non-tissue specific or tissue specific promoter may be used to control the expression of a TET-like protein (e.g. TET1-like protein) of the present disclosure.

The recombinant nucleic acids of the present disclosure and/or a vector housing a recombinant nucleic acid of the present disclosure, may also contain a regulatory sequence that serves as a 3' terminator sequence. One of skill in the art would readily recognize a variety of terminators that may be used in the recombinant nucleic acids of the present disclosure. For example, a recombinant nucleic acid of the present disclosure may contain a 3' NOS terminator. Further, a native terminator from a TET protein (e.g. a TET1 protein) of the present disclosure may also be used in the recombinant nucleic acids of the present disclosure.

Plant transformation protocols as well as protocols for introducing recombinant nucleic acids of the present disclosure into plants may vary depending on the type of plant or plant cell, e.g., monocot or dicot, targeted for transformation. Suitable methods of introducing recombinant nucleic acids of the present disclosure into plant cells and subsequent insertion into the plant genome include, for example, microinjection (Crossway et al., Biotechniques (1986) 4:320-334), electroporation (Riggs et al., Proc. Natl. Acad Sci. USA (1986) 83:5602-5606), *Agrobacterium*-mediated transformation (U.S. Pat. No. 5,563,055), direct gene transfer (Paszkowski et al., EMBO J. (1984) 3:2717-2722), and ballistic particle acceleration (U.S. Pat. No. 4,945,050; Tomes et al. (1995). "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin); and McCabe et al., Biotechnology (1988) 6:923-926).

Additionally, a TET-like protein (e.g. TET1-like protein) of the present disclosure can be targeted to a specific organelle within a plant cell. Targeting can be achieved by providing the recombinant protein with an appropriate targeting peptide sequence. Examples of such targeting peptides include, for example, secretory signal peptides (for secretion or cell wall or membrane targeting), plastid transit peptides, chloroplast transit peptides, mitochondrial target peptides, vacuole targeting peptides, nuclear targeting peptides, and the like (e.g., see Reiss et al., Mol. Gen. Genet. (1987) 209(1):116-121; Settles and Martienssen, Trends Cell Biol (1998) 12:494-501; Scott et al., J Biol Chem (2000) 10:1074; and Luque and Correas, J Cell Sci (2000) 113:2485-2495).

The modified plant may be grown into plants in accordance with conventional ways (e.g., see McCormick et al., Plant Cell. Reports (1986) 81-84.). These plants may then be grown, and pollinated with either the same transformed strain or different strains, with the resulting hybrid having the desired phenotypic characteristic. Two or more generations may be grown to ensure that the subject phenotypic characteristic is stably maintained and inherited and then seeds harvested to ensure the desired phenotype or other property has been achieved.

Methods of Reducing Methylation of a Target Nucleic Acid in Plants

Growing conditions sufficient for the recombinant TET-like polypeptides (e.g. TET1-like polypeptides) of the present disclosure to be expressed in the plant to be targeted to and reduce the methylation of one or more target nucleic acids of the present disclosure are well known in the art and include any suitable growing conditions disclosed herein. Typically, the plant is grown under conditions sufficient to express a recombinant polypeptide of the present disclosure (e.g. TET1-like proteins), and for the expressed recombinant polypeptide to be localized to the nucleus of cells of the plant in order to be targeted to and reduce the methylation of the target nucleic acids. Generally, the conditions sufficient for the expression of the recombinant polypeptide will depend on the promoter used to control the expression of the recombinant polypeptide. For example, if an inducible promoter is utilized, expression of the recombinant polypeptide in a plant will require that the plant to be grown in the presence of the inducer.

As noted above, growing conditions sufficient for the recombinant polypeptides of the present disclosure to be expressed in the plant to be targeted to and reduce methylation and/or activate or reduce the expression of one or more target nucleic acids may vary depending on a number of factors (e.g. species of plant, use of inducible promoter, etc.). Suitable growing conditions may include, for example, ambient environmental conditions, standard greenhouse conditions, growth in long days under standard environmental conditions (e.g. 16 hours of light, 8 hours of dark), growth in 12 hour light:12 hour dark day/night cycles, etc.

Various time frames may be used to observe activation in expression and/or targeted demethylation of a target nucleic acid according to the methods of the present disclosure. Plants may be observed/assayed for activation in expression and/or targeted demethylation of a target nucleic acid after, for example, about 5 days of growth, about 10 days of growth, about 15 days after growth, about 20 days after growth, about 25 days after growth, about 30 days after growth, about 35 days after growth, about 40 days after growth, about 50 days after growth, or 55 days or more of growth.

Reduced methylation of a target nucleic acid induced by targeting a TET-like protein (e.g. TET1-like protein) to the target nucleic acid may be stable in plants even in the absence of the TET-like protein (e.g. TET1-like protein) in the plant. Accordingly, the methods of the present disclosure may allow one or more target nucleic acids in a plant to maintain a reduced level of methylation after a nucleic acid encoding a TET-like protein (e.g. TET1-like protein) has been crossed out or otherwise removed from the plant. For example, after targeting a particular genomic region with a TET-like protein (e.g. TET1-like protein) protein according to the methods of the present disclosure, the reduced level of methylation of the targeted region may remain stable even after crossing away the transgenes. It is an object of the present disclosure to provide plants having reduced methylation of one or more target nucleic acids according to the methods of the present disclosure. As the methods of the present disclosure may allow one or more target nucleic acids in a plant to remain in their state of reduced methylation after a recombinant polynucleotide encoding a TET-like protein (e.g. TET1-like protein) of the present disclosure has been crossed out of the plant, the progeny plants of these plants may have reduced methylation of one or more target nucleic acids even in the absence of the recombinant polynucleotides that produce the recombinant polypeptides of the present disclosure.

A target nucleic acid of the present disclosure in a plant cell housing a TET-like protein (e.g. TET1-like protein) of the present disclosure may have its level of methylation reduced by at least about 5%, at least about 10%, at least about 15%, at least about 20%, at least about 25%, at least about 30%, at least about 40%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or at least about 100% as compared to a corresponding control. Various controls will be readily apparent to one of skill in the art. For example, a control may be a corresponding plant or plant cell that does not contain a nucleic acid encoding a TET-like protein (e.g. TET1-like protein) of the present disclosure.

A target nucleic acid of the present disclosure having reduced methylation as compared to a corresponding control nucleic acid may exhibit a reduction in methylation over a number of nucleotides including and adjacent to the targeted nucleotide sequences in a target nucleic acid. For example, the reduction in methylation may be present over one nucleotide, over about 5 nucleotides, over about 10 nucleotides, over about 15 nucleotides, over about 20 nucleotides, over about 25 nucleotides, over about 30 nucleotides, over about 35 nucleotides, over about 40 nucleotides, over about 45 nucleotides, over about 50 nucleotides, over about 55 nucleotides, over about 60 nucleotides, over about 75 nucleotides, over about 100 nucleotides, over about 125 nucleotides, over about 150 nucleotides, over about 175 nucleotides, over about 200 nucleotides, over about 225 nucleotides, over about 250 nucleotides, over about 275 nucleotides, over about 300 nucleotides, over about 350 nucleotides, over about 400 nucleotides, over about 450 nucleotides, over about 500 nucleotides, over about 600 nucleotides, over about 700 nucleotides, over about 800 nucleotides, over about 900 nucleotides, over about 1,000 nucleotides, over about 1,500 nucleotides, over about 2,000 nucleotides, over about 2,500 nucleotides, or over about 3,000 nucleotides or more as compared to corresponding nucleotides in a corresponding control nucleic acid. The reduction in methylation of nucleotides adjacent to the target nucleotides in the target nucleic acid may occur in nucleotides that are 5' to the target nucleotide sequences, 3' to the target nucleotides sequences, or both 5' and 3' to the target nucleotide sequences.

A target nucleic acid of the present disclosure may have its expression upregulated/activated as compared to a corresponding control nucleic acid. A target nucleic acid may have its expression upregulated at least about 1-fold, at least about 2-fold, at least about 3-fold, at least about 4-fold, at least about 5-fold, at least about 10-fold, at least about 15-fold, at least about 20-fold, at least about 25-fold, at least about 30-fold, at least about 40-fold, at least about 50-fold, at least about 75-fold, at least about 100-fold, at least about 150-fold, at least about 200-fold, at least about 300-fold, at least about 400-fold, at least about 500-fold, at least about 600-fold, at least about 700-fold, at least about 800-fold, at least about 900-fold, at least about 1,000-fold, at least about 1,250-fold, at least about 1,500-fold, at least about 1,750-fold, at least about 2,000-fold, at least about 2,500-fold, at least about 3,000-fold, at least about 3,500-fold or more as compared to a corresponding control nucleic acid. As stated above, various controls will be readily apparent to one of skill in the art. For example, a control nucleic acid may be a corresponding nucleic acid from a plant or plant cell that does not contain a nucleic acid encoding a TET-like protein (e.g. TET1-like protein) of the present disclosure.

A target nucleic acid of the present disclosure may have its expression downregulated/reduced, or silenced, as compared to a corresponding control nucleic acid. A target nucleic acid may have its expression reduced by at least about 1-fold, at least about 2-fold, at least about 3-fold, at least about 4-fold, at least about 5-fold, at least about 10-fold, at least about 15-fold, at least about 20-fold, at least about 25-fold, at least about 30-fold, at least about 40-fold, at least about 50-fold, at least about 75-fold, at least about 100-fold, at least about 150-fold, at least about 200-fold, at least about 300-fold, at least about 400-fold, at least about 500-fold, at least about 600-fold, at least about 700-fold, at least about 800-fold, at least about 900-fold, at least about 1,000-fold, at least about 1,250-fold, at least about 1,500-fold, at least about 1,750-fold, at least about 2,000-fold, at least about 2,500-fold, at least about 3,000-fold, at least about 3,500-fold or more as compared to a corresponding control nucleic acid. As stated above, various controls will be readily apparent to one of skill in the art. For example, a control nucleic acid may be a corresponding nucleic acid from a plant or plant cell that does not contain a nucleic acid encoding a TET-like protein (e.g. TET1-like protein) of the present disclosure.

Methods of probing the methylation status of a nucleic acid are well-known to those of skill in the art. For example, bisulfite sequencing and nucleic acid analysis may be used to determine the methylation status, on a nucleotide-by-nucleotide basis, of a population of nucleic acids isolated from a nucleic acid-containing sample (e.g. plants, plant tissues, or plant cells).

It is to be understood that while the present disclosure has been described in conjunction with the preferred specific embodiments thereof, the foregoing description is intended to illustrate and not limit the scope of the present disclosure. Other aspects, advantages, and modifications within the scope of the present disclosure will be apparent to those skilled in the art to which the present disclosure pertains.

EXAMPLES

The following examples are offered to illustrate provided embodiments and are not intended to limit the scope of the present disclosure.

Example 1: DNA-Binding Domain-Targeting of Demethylation Factor TET1 (Catalytic Domain) to the FWA Locus in *Arabidopsis*

This Example demonstrates the targeting of the catalytic domain of a TET1 protein to a specific locus to cause DNA demethylation in plants.

Introduction

DNA methylation controls gene expression in many different organisms, including plants. Applicant has previously shown that artificial zinc fingers (AZF) can be used for targeted methylation and repression of gene expression in *Arabidopsis* (Johnson et al, 2014). Using the same AZF, ZF108, this Example demonstrates targeted DNA demethylation in *Arabidopsis*. To do so, the catalytic domain of TET1, a protein involved in DNA demethylation in mammals (Ito et al, 2011, Gue et al, 2011) was heterologously fused to ZF108.

The TET1 catalytic domain has been shown to cause DNA demethylation in other organisms when artificially targeted to genomic locations using Artificial Zinc Fingers, Tal effectors and CRISPR/Cas9. However, such a method has not been shown to work in plants. Moreover, given that TET1 is not a native plant protein and given that plant DNA methylation is in many ways different from animal DNA methylation, it was not known that such a method could even work in plants.

In the present Example, Applicant fused the catalytic domain of TET1 to the C-terminal tail of ZF108 and expressed this fusion protein under the control of the constitutive promoter UBQ10 in wild-type *Arabidopsis* plants. TET1 catalytic domain was amplified from the pJFA334E9 plasmid provided by the Joung lab through Addgene. Importantly, ZF108 was designed to bind to the promoter of the reporter gene FWA in *Arabidopsis* (Johnson et al, 2013). In wild-type plants, this gene is repressed due to DNA methylation in its promoter. Absence of methylation causes FWA overexpression and an associated late flowering phenotype. Therefore, wild-type plants expressing the chimeric protein ZF108-TET1 (catalytic domain) were screened for a late flowering phenotype, indicative of FWA overexpression and a likely consequence of promoter de-methylation. From this screen, Applicant identified plants exhibiting a late flowering phenotype as compared to wild-type plants. Following identification of these late flowering plants, their DNA was extracted and digested with the methylation-sensitive restriction enzyme McrBC. The results demonstrated that plants expressing ZF108-TET1 (catalytic domain) had low methylation at the FWA promoter compared to wild type. Whole-genome Bisulfite Sequencing was performed to analyze the impact of ZF108-TET1 (catalytic domain) genome-wide. Finally, gene expression of the same samples was analyzed by RNA-seq in order to observe potential changes in gene expression due to demethylation.

Materials and Methods

Cloning of pUBQ10::ZF_3xFlag_TET1-CD

For this purpose, a modified pMDC123 plasmid (Curtis et al, 2003, Plant Phys) was created first, containing 1990 bp of the promoter region of *Arabidopsis* UBQ10 gene upstream of the BLRP_ZF108_3xFlag cassette. Both UBQ10 promoter and BLRP_ZF108_3xFlag are upstream of the gateway cassette (Invitrogen) present in the original pMDC123 plasmid. The catalytic domain of the human TET1 protein (TET1-CD) was amplified from the plasmid pJFA334E9 (Addgene) and cloned into pENTR/D plasmid (Invitrogen) and then delivered into the modified pMDC123 by LR reaction (Invitrogen), creating an in-frame fusion of TET1_CD cDNA with the upstream BLRP_ZF108_3xFlag cassette.

The nucleotide sequence of pUBQ10::ZF108_3xFlag_TET1-CD is presented in SEQ ID NO: 21. This expression cassette contains a UBQ10 promoter (SEQ ID NO: 22), the ZF108 DNA-binding domain that targets the FWA promoter (SEQ ID NO: 23), a 3X Flag tag (SEQ ID NO: 24), the catalytic domain of human TET1 (SEQ ID NO: 25), and an OCS terminator sequence (SEQ ID NO: 26). The pUBQ10::ZF108_3xFlag_TET1-CD expression cassette encodes the ZF108_3xFlag_TET1-CD fusion protein, whose amino acid sequence set forth in SEQ ID NO: 27. Polypeptides in the fusion protein include ZF108 (SEQ ID NO: 28), 3xFlag (SEQ ID NO: 29), and human TET1-CD (SEQ ID NO: 30).

Plant Transformation and Flowering Time Measurement

The construct above was introduced into Col-0 wild-type *Arabidopsis thaliana* plants using *Agrobacterium*-mediated transformation. T1 transgenic plants were selected based on their resistance to BASTA. Following selection, plants were grown on soil under a long day photoperiod until the plants flowered. Flowering time was scored by measuring the number of rosette and caulinar leaves.

CHOP-PCR

Plant DNA was extracted following a CTAB-based protocol. 1 µg DNA was digested with the methylation sensitive enzyme McrBC for 4 h at 37° C. As a non-digested control, 1 µg of DNA was incubated for 4h at 37° C. in digestion buffer without the enzyme. Quantitative Real-time PCR was done to amplify a region of the FWA promoter using the oligos (ttgggtttagtgtttacttg) (SEQ ID NO: 167) and (gaatgttgaatgggataaggta) (SEQ ID NO: 168). As a control region, the gene body of another gene was analyzed using the oligos (tgcaatttgtctgcttgctaatg) (SEQ ID NO: 169) and (tcatttataatggacgatgcc) (SEQ ID NO: 170). After PCR, the ratio of digested over non-digested DNA was calculated.

Bisulfate Sequencing and Data Analysis

BS-Seq libraries were generated as previously reported (Cokus et al., 2008) and all libraries were sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq, up to 2 mismatches were allowed and only uniquely mapped reads were used.

RNA-Seq

Raw reads in qseq format obtained from the sequencer were first converted to fastq format with a customized perl script. Read quality was controlled with FastQC (http://svww.bioinformatics.babraham.ac.uk/projects/fastqc). High quality reads were then aligned to hg19 reference genome using Tophat (Trapnell et al, 2009) (v 2.0.13) by using '-no-coverage-search' option, allowing up to two mismatches and only keeping reads that mapped to one location. Essentially, reads were first mapped to TAIR10 gene annotation with known splice junction. When reads did not map to the annotated genes, the reads were mapped to hg19 genome. The number of reads mapping to genes were calculated by HTseq (Anders et al., 2015) (v 0.5.4) with default parameters. Expression levels were determined by RPKM (reads per kilobase of exons per million aligned reads) in R using customized scripts.

Results

To explore whether ZF108_TET1-CD would be able to trigger demethylation and reactivate the expression of FWA, wild-type Col-0 plants were transformed with the ZF108_TET1-CD containing construct described above. Flowering time of T1 transgenic plants was assayed, and results are presented below in Table 1A.

TABLE 1A

Flowering Time Results

| Line | Early flowering | Late flowering |
|---|---|---|
| ZF108_TET1_CD | 32 | 25 |

Figure 1:
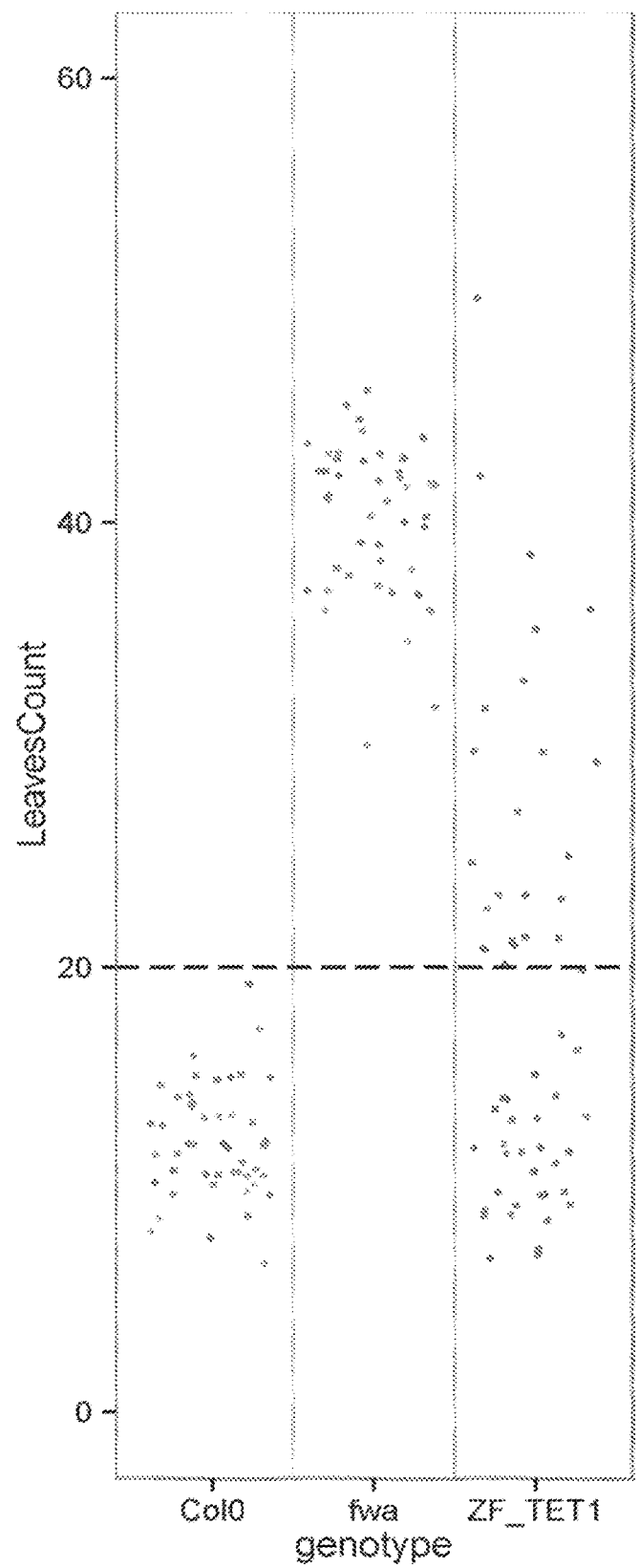
FIG. 1 illustrates flowering time in Col-0 wild-type plants, fwa mutant plants, and T1 transgenic plants carrying the ZF108_TET1-CD construct in the Col-0 background.

The results presented in Table 1A demonstrate that the catalytic domain of human TET1 fused to a zinc finger that targets the FWA locus can efficiently promote late flowering in wild-type plants. A more through assessment of these results is presented in FIG. 1. From FIG. 1, it is seen that wild-type Col-0 plants exhibit their normal "early" flowering time. In contrast, fwa mutants, which contain an epimutation in the FWA promoter that results in loss of methylation at the FWA promoter and consequent activation/expression of FWA (a flowering time repressor), exhibit their canonical "late" flowering time phenotype. Interestingly, a number of plants carrying the ZF108_TET1-CD construct in the Col-0 genetic background exhibited a "late" flowering phenotype more analogous to fwa mutants, suggesting that this construct can promote late flowering in otherwise wild-type plants.

Figure 2:
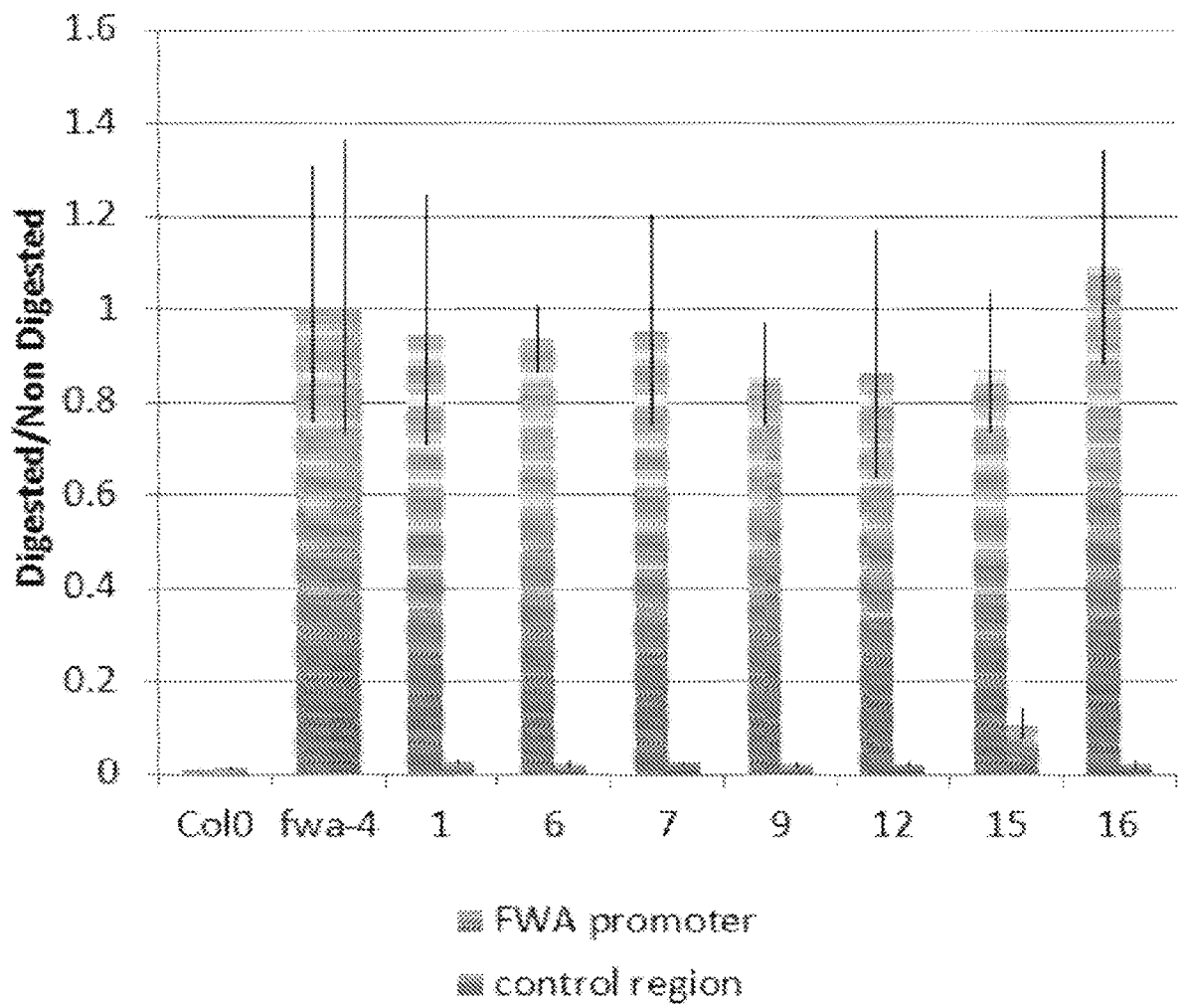
FIG. 2 illustrates results of CHOP-PCR in Col-0 wild-type plants, fwa mutant plants, and T1 transgenic plants carrying the ZF108_TET1-CD construct in the Col-0 background. DNA of different lines as shown in the figure (ZF108_TET1-CD lines are labelled #1, 6, 7, 9, 12, 15, and 16) were digested with the DNA methylation sensitive enzyme McrBC. A region of the FWA promoter was analyzed. As a control region, the DNA methylated gene body of another gene was analyzed. The height of each bar represents the ratio of the amount of PCR product from the McrBC digested sample to the amount of PCR product from the undigested sample.

In order to analyze whether the late flowering phenotype of plants harboring ZF108_TET1-CD as described in Table 1A was due to de-methylation of the FWA promoter, CHOP-PCR using the methylation sensitive enzyme McrBC was performed on DNA obtained from these plants. As shown in FIG. 2, the digested/non-digested profile for the FWA promoter in plants harboring the ZF108_TET1-CD construct is similar to the FWA promoter profile for fwa-4 plants, indicative of a lack of DNA methylation at the FWA promoter. However, while fwa-4 plants show demethylation also at the control region analyzed, the ZF108_TET1-CD lines show a profile at the control region that is similar to wild-type plants, suggesting that demethylation is happening specifically at the FWA promoter.

Figure 3:
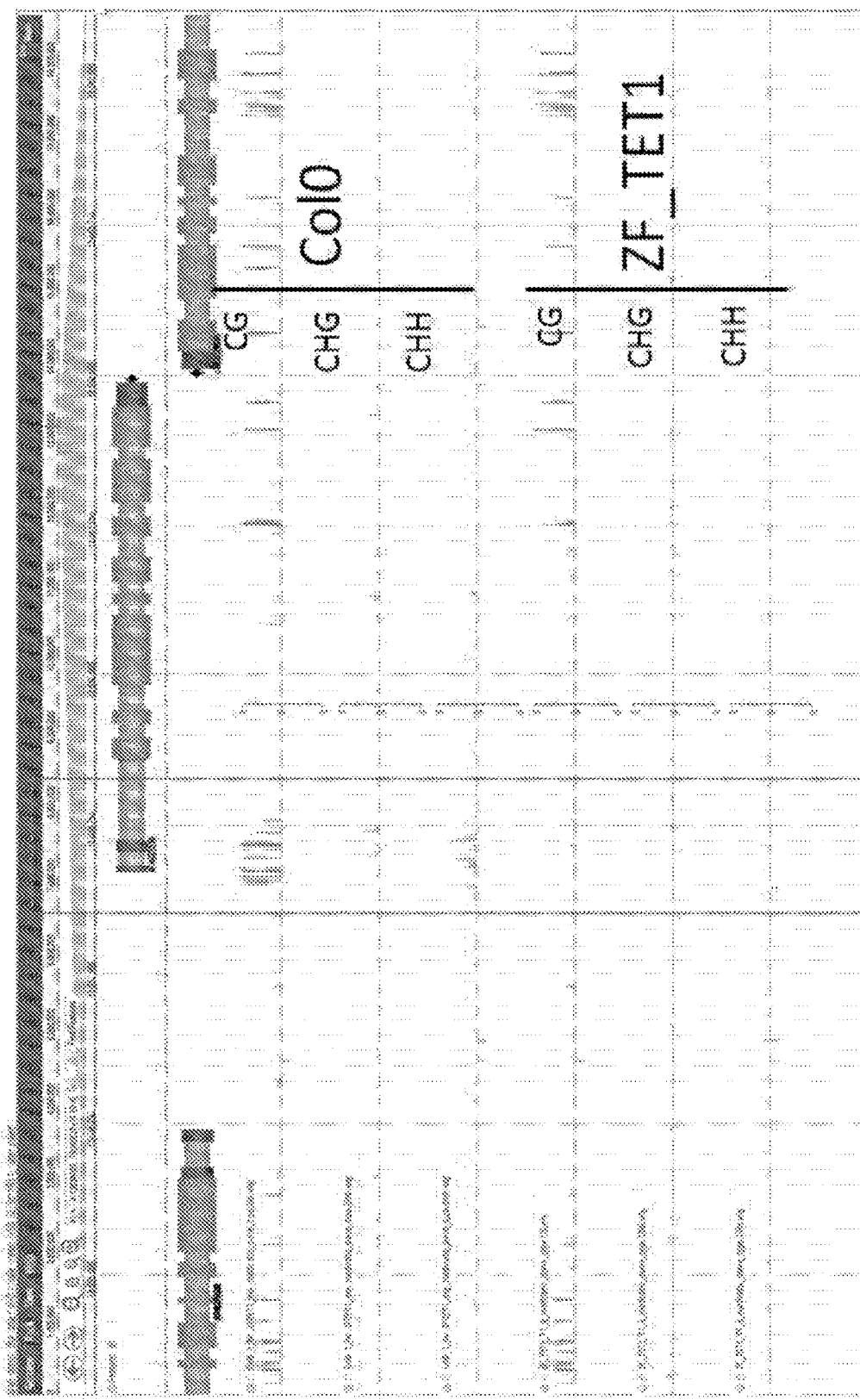
FIG. 3 illustrates Whole Genome Bisulfite Sequencing results. DNA methylation of four independent transgenic lines carrying the ZF108_TET1-CD construct that showed the late flowering phenotype were analysed by BS-seq. Methylation at different contexts (CG, CHG and CHH, where H is C, T, or A) is shown for a wild-type Col-0 plant and a representative ZF108_TET1-CD line. The FWA promoter region is marked in a red box.
Figure 4:
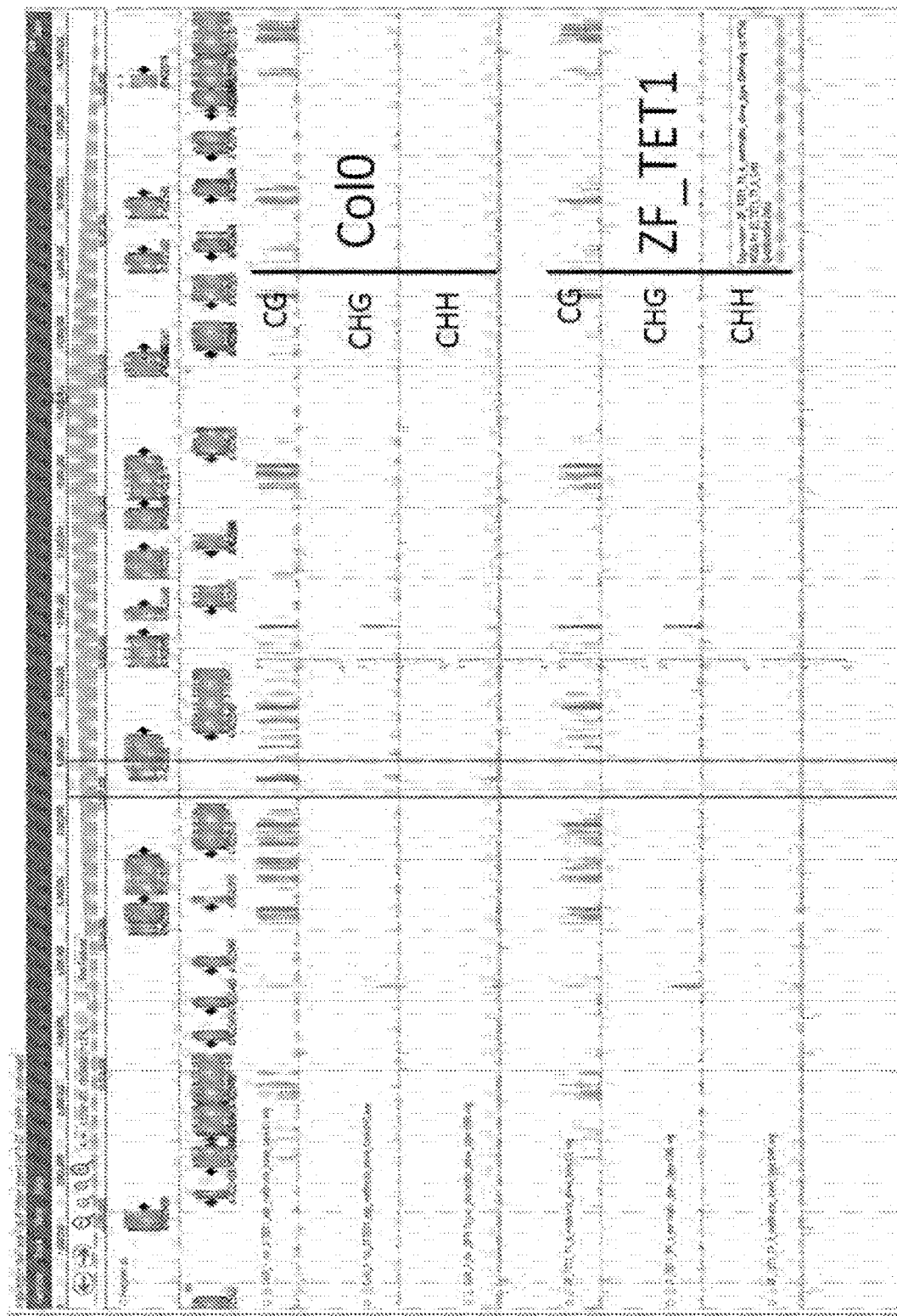
FIG. 4 illustrates a zoomed-out view of the Whole Genome Bisulfite Sequencing results presented in FIG. 3. DNA methylation of four independent transgenic lines carrying the ZF108_TET1-CD construct that showed the late flowering phenotype were analysed by BS-seq. Methylation at different contexts (CG, CHG and CHH, where H is C, T, or A) is shown for a wild-type Col-0 plant and a representative ZF108_TET1-CD line. The FWA promoter region is marked in a red box.

To further investigate the loss of methylation at the FWA promoter that appeared to be conferred by ZF108_TET1-CD, a whole-genome bisulfate sequencing assay was performed in four independent ZF108_TET1-CD lines that showed the late flowering phenotype. Bisulfite sequencing experiments were conducted as described above. The results, which are presented in FIG. 3 and FIG. 4, show that effective DNA demethylation was achieved by targeting the TET1 catalytic domain to the FWA promoter. Importantly, this effect was specific to the FWA promoter, and other methylated regions in the general vicinity of the targeted genomic region were not affected (FIG. 4).

Figure 5:
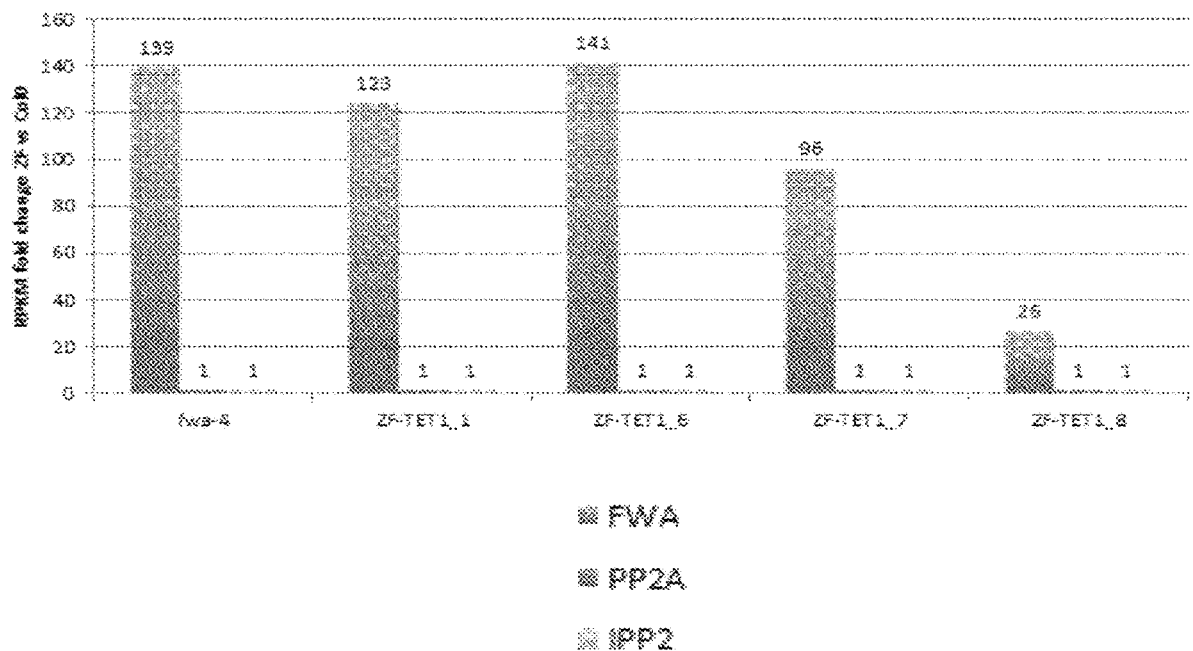
FIG. 5 illustrates RNA-seq analysis of Col-0 wild-type plants, fwa mutant plants, and T1 transgenic plants carrying the ZF108_TET1-CD construct. Four independent ZF108_TET1-CD lines, fwa-4 plants, and wild-type Col-0 control plants were analysed by RNA-seq. RPKM fold change between wild-type Col-0 and ZF108_TET1-CD lines, or between wild-type Col-0 and fwa-4, is presented for the FWA gene and the control housekeeping genes PP2A and IPP2. The fold change value in expression of each gene in the indicated line as compared to Col-0 wild-type plants is indicated on top of each bar.

In order to determine if the late flowering phenotype observed in the different ZF108_TET1-CD lines was due to the activation of FWA expression, RNA-seq was performed with four independent T1 lines. The results presented in FIG. 5 show that FWA was upregulated in all transgenic lines tested, while two control housekeeping genes remained unaffected. The results with the ZF108_TET1-CD transgenic lines were comparable to the results observed in fwa-4 plants, which are known to exhibit loss of methylation at the FWA promoter and have activated expression of FWA as compared to wild-type plants. Thus, the results presented in this Example demonstrate that specific targeting of the TET1 catalytic domain to a genomic region of interest can be used to target demethylation and gene activation in plants in a very specific manner.

Example 2: CRISPR-Targeting of a TET1 Polypeptide to Specific Loci

This Example describes exemplary experimental guidelines for constructing fusion constructs containing TET1 polypeptides as disclosed herein fused to dCAS9 proteins. These constructs may be used to target a TET1 polypeptide to a specific locus of a plant genome using the CRISPR-CAS9 system to induce de-methylation of the target nucleic acid. This particular example describes exemplary constructs to target the FWA locus.

Materials and Methods

Construction of TET1-CD Fusion Proteins and gRNA-Fwa

For this purpose, a modified pMDC123 plasmid (Curtis et al, 2003, Plant Phys) will be created first. A fragment containing 1986 bp of the promoter region of *Arabidopsis* UBQ10 gene will be cloned, followed by an omega RBC translational enhancer and then a human codon optimized dCAS9 creating pMDC UBQ10_dCAS9_Gateway. An attL1 site followed by an HA tag, two nuclear localization signals (NLS), the catalytic domain of TET1 protein (TET1-CD), and a attL2 site will be created through gene synthesis and inserted into pUC57 to create pUC57 attL1_1xHA_2xNLS_TET1-CD_attL2. The 1xHA_2xNLS_TET1-CD will be delivered into pMDC UBQ10_dCAS9_Gateway by LR reaction (Invitrogen) creating an in-frame fusion of 1xHA_2xNLS_TET1-CD with the upstream dCAS9 cassette creating pMDC UBQ10_dCAS9_1xHA_2xNLS_TET1-CD.

Three different gRNA expression cassettes, a gRNA cassette driven by a U6 promoter expressing a single gRNA, a tRNA-gRNA expression cassette driven by a U6 promoter with two different gRNAs, and a tRNA-gRNA expression cassette driven by a U6 promoter with four different gRNAs will be created by gene synthesis. Independent of each other, each individual gRNA system will be inserted at the PmeI restriction site of pMDC UBQ10_dCAS9_1xHA_2xNLS_TET1-CD upstream of the UBQ10 promoter creating: pMDC U6_gRNA_UBQ10_dCAS9_1xHA_2xNLS_TET1-CD, pMDC U6_tRNA-gRNAx2_UBQ10_dCAS9_1xHA_2xNLS_TET1-CD, and pMDC U6_tRNA_gRNAx4_UBQ10_dCAS9_1xHA_2xNLS_TET1-CD.

The exemplary expression cassette of UBQ10_dCAS9_1xHA_2xNLS_TET1-CD will contain a number of features. The nucleotide sequence of the expression cassette is presented in SEQ ID NO: 31. This cassette includes a UBQ10 promoter (SEQ ID NO: 32), an Omega RBC (SEQ ID NO: 33), a dCAS9 polypeptide (SEQ ID NO: 34), 1X HA tag (SEQ ID NO: 35), a nuclear localization signal (SEQ ID NO: 36), a linker (SEQ ID NO: 37), the catalytic domain of human TET1 (TET1-CD) (SEQ ID NO: 38), and an OCS terminator sequence (SEQ ID NO: 39).

The amino acid sequence of dCas9_1xHA_2xNLS_TET1-CD fusion protein is presented in SEQ ID NO: 40. The following amino acid sequences are present in this fusion protein: dCAS9 (SEQ ID NO: 41), 1X HA (SEQ ID NO: 42), 2xNLS (SEQ ID NO: 43), linker (SEQ ID NO: 44), and TET1-CD (SEQ ID NO: 45).

To target the FWA locus, various gRNA sequences will be tested, as presented in Table 2A. These gRNA sequences will be present in single gRNA cassettes as well as in a series of tRNA-gRNA expression cassettes. CRISPR-targeting technology involving tRNA-gRNA expression cassettes is described in Xie et al, PNAS (2015). This will allow for the delivery of multiple gRNAs simultaneously with high expression level.

TABLE 2A gRNA Molecules Targeting the FWA Promoter

| gRNA Name | crRNA Sequence (5' → 3') |
|---|---|
| gRNA3 | ATTCTCGACGGAAAGATGTA (SEQ ID NO: 171) |
| gRNA4 | ACGGAAAGATGTATGGGCTT (SEQ ID NO: 172) |
| gRNA12 | TTCATACGAGCGCCGCTCTA (SEQ ID NO: 173) |
| gRNA14 | CCATTGGTCCAAGTGCTATT (SEQ ID NO: 174) |
| gRNA16 | GCGGCGCAAGATCTGATATT (SEQ ID NO: 175) |
| gRNA17 | AAAACTAGGCCATCCATGGA (SEQ ID NO: 176) |

One exemplary tRNA-gRNA expression cassette will contain two different gRNA molecules: gRNA4 and gRNA17. This cassette will be called U6p::tRNA-4-17, and the nucleotide sequence of this cassette is presented in SEQ ID NO: 46. Other features of this cassette include a U6 promoter (SEQ ID NO: 47), tRNA (SEQ ID NO: 48), gRNA backbone (SEQ ID NO: 49), and a PolIII terminator sequence (SEQ ID NO: 50).

Another exemplary tRNA-gRNA expression cassette will contain four different gRNA molecules: gRNA16, gRNA14, gRNA3, and gRNA17. This cassette will be called U6p::tRNA-16-14-3-17, and the nucleotide sequence of this cassette is presented in SEQ ID NO: 51. Other features of this cassette include a U6 promoter (SEQ ID NO: 47), tRNA (SEQ ID NO: 48), gRNA backbone (SEQ ID NO: 49), and a PolIII terminator sequence (SEQ ID NO: 50).

Transformation of Col-0 Plants

The construct described above will be transformed into Col-0 wild-type plants using *Agrobacterium*-mediated genetic transformation (after the construct is transformed into *Agrobacterium*). This process involves transforming plants via floral dip using methods well-known in the art.

Flowering Time Measurements

Progeny of transformed plants (T1s) will be planted and screened for BASTA-resistant plants that incorporate the T-DNA into the *Arabidopsis* genome, which confers resistance to BASTA. Among the BASTA-resistant transgenic plants, flowering time will be measured and compared to early-flowering wild-type Col-0 and late-flowering fwa-4 plants. Flowering time will be measured by counting the total number of leaves (rossette and cauline) of each individual plant.

Data Analysis

Plants transformed with the fusion constructs described above will be evaluated for phenotypic differences as compared to corresponding control plants (e.g. wild-type plants and fwa-4 plants) which are suggestive of successful fusion protein targeting to the locus of interest and subsequent de-methylation and/or transcriptional activation at the locus. The phenotype evaluated may vary depending on the locus targeted. Other analyses to be performed may include measuring the expression level of the targeted locus in the transformed plants, measuring the degree of DNA methylation at the targeted locus in the transformed plants (using e.g. bisulfite sequencing), or other assays well-known to those of skill in the art.

It is thought that the fusion proteins containing a TET1-polypeptide as described herein and a dCAS9 protein will be able to successfully target a locus of interest and induce DNA de-methylation of the target locus.

Example 3: Modified CRISPR-Targeting of TET1 Polypeptide to Specific Loci Using MS2 Coat Proteins This Example describes exemplary experimental guidelines for constructing recombinant constructs for use in a modified CRISPR-targeting scheme involving TET1 polypeptides as disclosed herein, dCAS9 proteins, and MS2 coat proteins. These constructs may be used to target a TET1 polypeptide to a specific locus of a genome using the CRISPR-CAS9 system.

Example 2 describes the recombinant fusing of TET1 polypeptides to a dCAS9 protein to target TET1 to a specific locus (e.g. FWA locus). However, it is possible that in some instances, the fusion between the TET1 polypeptide and the dCAS9 protein may impact the function of the TET1 polypeptide, the dCAS9 protein, or both the TET1 polypeptide and the dCAS9 protein. Indeed, it is already known that recombinant fusion of heterologous proteins fused to CAS9 proteins can impact CAS9 function. For example, Morita et al (Nature Biotechnology 34, 1060-1065 (2016)) demonstrated that targeted demethylation using TET1 in animal cells is more efficient using the SunTag system, where TET1 is not fused directly to dCas9, as compared to standard straight fusions of TET1 to dCas9 through a small linker.

One way to circumvent the potential issues with CAS9 fusion proteins is to use other methods of CRISPR-targeting the TET1 polypeptide to the locus of interest other than by fusing the TET1 polypeptide to the dCAS9 protein. One such method involves adding a small RNA sequence that binds to a specific protein which can then be fused to the TET1 polypeptide. Recently, work by Konermann et al. 2014 showed that two loops in the gRNA backbone (tetraloop and stem 2) can be modified without negative effects on gRNA-CAS9 activity. They added to these loops a hairpin aptamer that selectively binds dimerized MS2 bacteriophage coat proteins and showed that MS2-mediated recruitment of the transcriptional activator VP64 to the gRNA-CAS9 complex was able to induce expression of a target gene.

Figure 6:
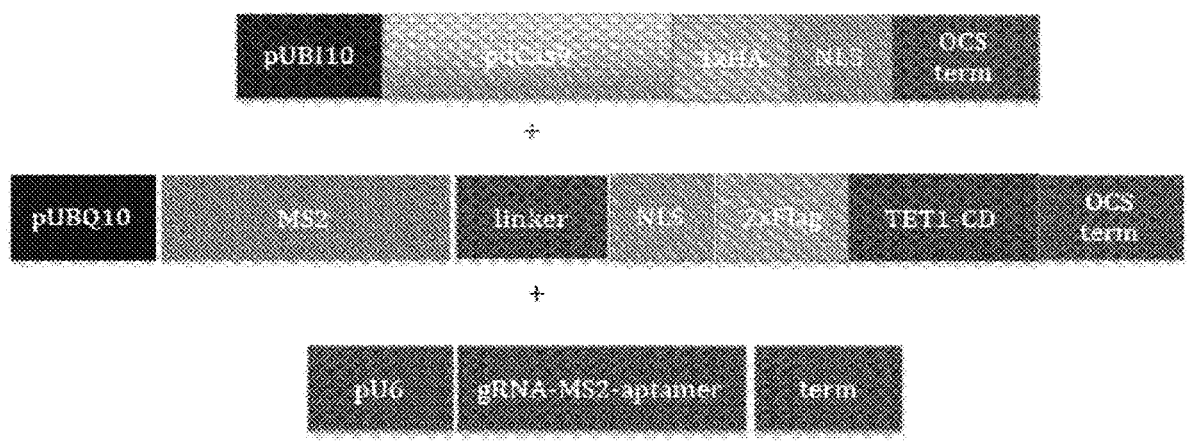
FIG. 6 illustrates the structure of exemplary fusion constructs used in a modified CRISPR-targeting scheme involving the use of MS2 proteins.

A similar technique will be used herein to bypass the possible negative effect that a TET1 polypeptide or the CAS9 protein may have on each other's activity when expressed as a fusion protein in a plant cell. A fusion protein between MS2 and the catalytic domain of TET1 (TET1-CD) will be constructed. The diagram presented in FIG. 6 is a representative scheme of this three component system: (CAS9/gRNA-MS2-aptamer/MS2-TET1-CD).

A guide RNA designed to target the FWA locus will be fused to the MS2 aptamer to guide the MS2-TET1-CD fusion protein to FWA via the dCAS9 protein.

Other RNA-binding proteins may also be used in place of MS2, such as PP7 and COM.

Construction of TET1-CD Fusion Proteins and gRNA-Fwa

Cloning of m4UC_dCas9_MS2_TET1-CD_gRNAMS2. For this purpose, the m4UC_UBQ10_dCas9 vector will be used. This vector contains 2 kb of the 5' promoter of *Arabidopsis* UBQ10 gene driving expression of a plant codon-optimized dCas9 that is fused in its C-terminus to 1xHA tag and N7 Nuclear Localization Signals (N7-NLS). A catalytically inactive Cas9, dCas9, will be generated by site directed mutagenesis to change D10A and H840 amino acids. Next, a modified pMDC123 vector (Curtis et al, Plant Phys, 2003) containing 700 bp of the 3' OCS terminator will be used. 2 kb of UBQ10 promoter, the MS2 binding protein sequence containing 3xGGGS flexible linker, one NLS (Konermann et al Nature. 2014), and 2xFlag sequence will be PCR amplified and cloned in this order by Infusion (Clontech) into the unique AscI site upstream of the gateway cassette of the modified pMDC123 to create pMDC123 MS2. The fragment of pMDC123 MS2 containing the UBQ10 promoter MS2_GatewayCassette_OCS terminator will be PCR amplified and inserted by InFusion (Clontech) into the unique PmeI site of m4UC_UBQ10_dCas9 vector to create the m4UC_MS2 vector. A pENTR vector (Invitrogen) containing a cDNA of the TET1 catalytic domain (TET1-CD) will be used to deliver TET1-CD into m4UC_MS2 by LR reaction (Invitrogen) to create the m4UC_MS2_TET1_CD vector. Finally, the *Arabidopsis* U6 promoter and a gRNA with MS2 loops at tetraloop and stemloop 2 (Konermann et al Nature. 2014) will be PCR amplified and cloned into the unique PmeI site of the m4UC_MS2_TET1CD vector by Infusion (Clontech). Different 20nt-long gRNA protospacers against the FWA promoter will be cloned into the gRNA MS2 cassette by PCR. In order to change the target sequence present in the different gRNAs, the protocol described in Li et al., 2013 using the plasmid pUC-gRNA will be followed.

The exemplary expression cassette of m4UC_dCas9_MS2_TET1-CD_RNAMS2 will contain a number of features. The nucleotide sequence of the expression cassette is presented in SEQ ID NO: 54. This cassette is described as a single cassette, but contains a number of different expression regions: (1) one that encodes a gRNA targeting the FWA promoter, (2) one that encodes the dCAS9 coding region, and (3) one that encodes the MS2-TET1-CD fusion protein. The cassette includes a gRNA (SEQ ID NO: 55), a U6 promoter (SEQ ID NO: 56), an OCS terminator (SEQ ID NO: 57), TET1-CD (SEQ ID NO: 58), 2x FLAG (SEQ ID NO: 59), NLS (SEQ ID NO: 60), 3xGGGGS (SEQ ID NO: 61), MS2 (SEQ ID NO: 62), UBQ10 promoter (SEQ ID NO: 63), Insulator (SEQ ID NO: 64), UBQ10 promoter (SEQ ID NO: 65), Omega enhancer (SEQ ID NO: 66), dCAS9 (SEQ ID NO: 67), and an OCS terminator (SEQ ID NO: 68).

The amino acid sequence of the polypeptide fusion of dCAS9 HA 7N-NLS is presented in SEQ ID NO: 69. The following amino acid sequences are present in this fusion protein: dCAS9 (SEQ ID NO: 70), 1X HA (SEQ ID NO: 71), 7N-NLS (SEQ ID NO: 72).

The amino acid sequence of the polypeptide fusion of MS2_3xGGGGS_NLS_2xFlag_TET1-CD is presented in SEQ ID NO: 73. The following amino acid sequences are present in this fusion protein: MS2 (SEQ ID NO: 74), 3xGGGGS (SEQ ID NO: 75), NLS (SEQ ID NO: 76), 2xFLAG (SEQ ID NO: 77), TET1-CD (SEQ ID NO: 78).

To target the FWA locus, various gRNA sequences will be tested, as presented in Table 3A.

Various gRNA sequences will also be present in a series of tRNA-gRNA expression cassettes. CRISPR-targeting technology involving tRNA-gRNA expression cassettes is described in Xie et al, PNAS (2015). This will allow for the delivery of multiple gRNAs simultaneously with high expression level.

TABLE 3A gRNA Molecules Targeting the FWA Promoter

| gRNA Name | crRNA Sequence (5' → 3') |
|---|---|
| gRNA3 | ATTCTCGACGGAAAGATGTA (SEQ ID NO: 171) |
| gRNA4 | ACGGAAAGATGTATGGGCTT (SEQ ID NO: 172) |
| gRNA12 | TTCATACGAGCGCCGCTCTA (SEQ ID NO: 173) |
| gRNA14 | CCATTGGTCCAAGTGCTATT (SEQ ID NO: 174) |

TABLE 3A-continued gRNA Molecules Targeting the FWA Promoter

| gRNA Name | crRNA Sequence (5' → 3') |
|---|---|
| gRNA16 | GCGGCGCAAGATCTGATATT (SEQ ID NO: 175) |
| gRNA17 | AAAACTAGGCCATCCATGGA (SEQ ID NO: 176) |

Figure 7:
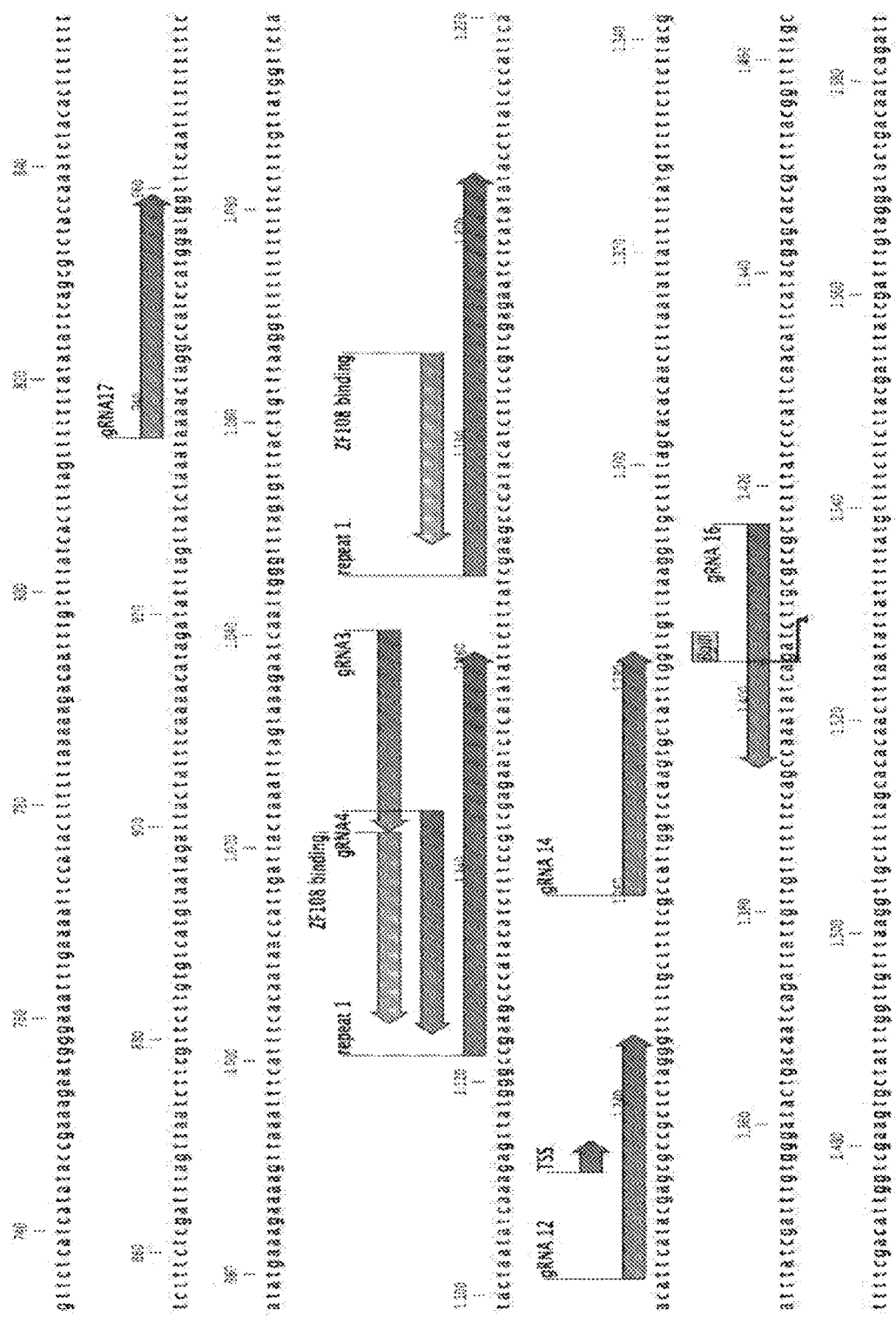
FIG. 7 illustrates how various crRNA sequences map to the FWA locus (SEQ ID NO: 195).

An appropriate crRNA sequence will be used in the gRNA structure described above (See SEQ ID NO: 55). FIG. 7 illustrates how various crRNA sequences and the flanking PAM sequence map to the FWA locus.

For tRNA-gRNA cassettes, one exemplary tRNA-gRNA expression cassette will contain two different gRNA molecules: gRNA4 and gRNA17. This cassette will be called U6p::tRNA-4-17, and the nucleotide sequence of this cassette is presented in SEQ ID NO: 46. Other features of this cassette include a U6 promoter (SEQ ID NO: 47), tRNA (SEQ ID NO: 48), gRNA backbone (SEQ ID NO: 49), and a PolIII terminator sequence (SEQ ID NO: 50).

Another exemplary tRNA-gRNA expression cassette will contain four different gRNA molecules: gRNA16, gRNA14, gRNA3, and gRNA17. This cassette will be called U6p::tRNA-16-14-3-17, and the nucleotide sequence of this cassette is presented in SEQ ID NO: 51. Other features of this cassette include a U6 promoter (SEQ ID NO: 47), tRNA (SEQ ID NO: 48), gRNA backbone (SEQ ID NO: 49), and a PolIII terminator sequence (SEQ ID NO: 50).

Transformation of Col-0 Plants

The construct described above will be transformed into Col-0 wild-type plants using *Agrobacterium*-mediated genetic transformation (after the construct is transformed into *Agrobacterium*). This process involves transforming plants via floral dip using methods well-known in the art.

Flowering Time Measurements

Progeny of transformed plants (T1s) will be planted and screened for BASTA-resistant plants that incorporate the T-DNA into the *Arabidopsis* genome, which confers resistance to BASTA. Among the BASTA-resistant transgenic plants, flowering time will be measured and compared to early-flowering wild-type Col-0 and late-flowering fwa-4 plants. Flowering time will be measured by counting the total number of leaves (rossette and cauline) of each individual plant.

Data Analysis

Plants transformed with the fusion constructs described above will be evaluated for phenotypic differences as compared to corresponding control plants (e.g. wild-type plants and fwa-4 plants) which are suggestive of successful targeting of the TET1 polypeptide to the locus of interest and subsequent de-methylation and/or transcriptional activation at the locus. The phenotype evaluated may vary depending on the locus targeted. Other analyses to be performed may include measuring the expression level of the targeted locus in the transformed plants, measuring the degree of DNA methylation at the targeted locus in the transformed plants (using e.g. bisulfite sequencing), or other assays well-known to those of skill in the art.

It is thought that the targeting scheme described in this Example will be able to successfully target a locus of interest and induce DNA de-methylation of the target locus.

Example 4: Modified CRISPR-Targeting of TET1 Polypeptide to Specific Loci Using SunTag Constructs This Example describes exemplary experimental guidelines for constructing recombinant constructs for use in a modified CRISPR-targeting scheme involving TET1 polypeptides as disclosed herein, dCAS9 proteins, and SunTag constructs. These constructs may be used to target a TET1 polypeptide to a specific locus of a genome using the CRISPR-CAS9 system.

Example 2 describes the recombinant fusing of TET1 polypeptides to a dCAS9 protein to target TET1 to a specific locus (e.g. FWA locus). However, it is possible that in some instances, the fusion between the TET1 polypeptide and the dCAS9 protein may impact the function of the TET1 polypeptide, the dCAS9 protein, or both the TET1 polypeptide and the dCAS9 protein. Indeed, it is already known that recombinant fusion of heterologous proteins fused to CAS9 proteins can impact CAS9 function. For example, Morita et al (Nature Biotechnology 34, 1060-1065 (2016)) demonstrated that targeted demethylation using TET1 in animal cells is more efficient using the SunTag system, where TET1 is not fused directly to dCas9, as compared to standard straight fusions of TET1 to dCas9 through a small linker.

A technique called SunTag was developed to recruit many effector proteins simultaneously to a location via one dCAS9 protein. In this way, there is an amplification of the effect of targeting, and improved magnitude of gene regulation (Tanenbaum et al, 2014). Tanenbaum et al. described that a dCas9 protein was fused to an unstructured peptide that contains up to 24 copies of the GCN4 epitope. A single chain antibody, scFV, designed to bind this peptide sequence with high affinity and specificity, was fused to an effector protein for gene regulation. Co-expression of the two components allows binding of up to 24 copies of the antibody-fused effector protein to each CAS9-GCN4 fusion protein. In the case of VP64 as an effector protein, this procedure resulted in very high activation of gene expression compared to simple CAS9-VP64 fusion proteins.

Recently, Morita et al (Nature Biotechnology 34, 1060-1065 (2016)) described a SunTag system that is capable of triggering targeted demethylation when using the TET1 catalytic domain (TET1-CD) in mammalian cells and systems. In this system, dCas9 is fused to an unstructured peptide that contains 5 copies of the GCN4 epitope. A single chain antibody, scFv, designed to bind this peptide sequence with high affinity and specificity, is fused to TET1-CD. Co-expression of the two components allowed binding of up to 5 copies of the antibody-fused effector protein to each Cas9-GCN4 protein. In case of TET1-CD as an effector protein, this procedure resulted in very high demethylation compared to straight fusions of TET1-CD to dCAS9.

Figure 8:
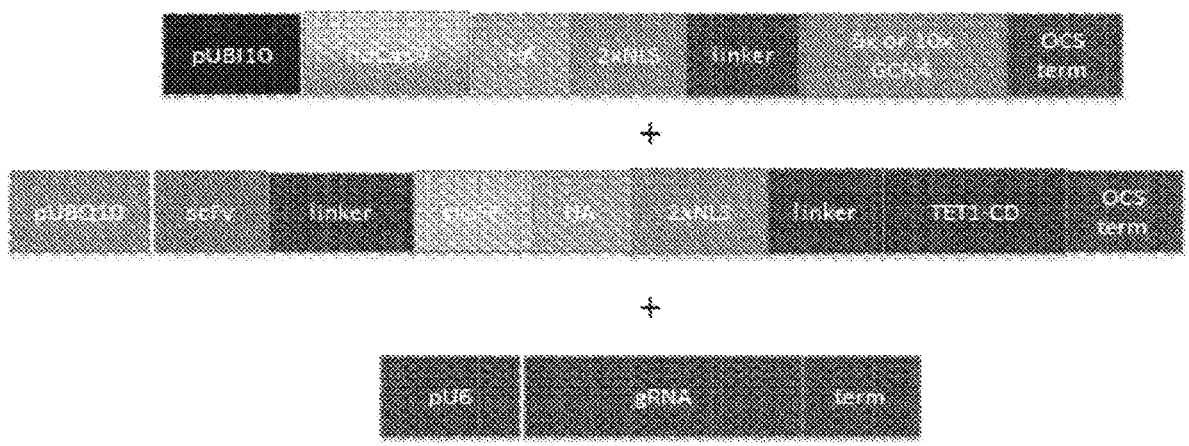
FIG. 8 illustrates the structure of exemplary fusion constructs used in a modified CRISPR-targeting scheme involving the use of SunTag constructs.

A similar technique will be used herein to allow multiple copies of a TET1 polypeptide to bind a dCAS9-GCN4 fusion protein. The diagram presented in FIG. 8 illustrates an exemplary scheme of this targeting system. A guide RNA designed to target the FWA locus will be co-expressed with the U6 promoter as in the schemes.

Construction of TET1-CD Fusion Proteins and gRNA-fwa

Construction of UBQ10_dCAS9_1xHA_2xNLS_5xGCN4_UBQ10_scFV_sfGFP_1xHA_2xNLS_TET1CD. For this purpose, a modified pMTN3164 plasmid and a modified pC1300 plasmid will be created first. dCAS9_1xHA_2xNLS_10xGCN4 will be created through gene synthesis and will be cloned downstream of a fragment containing 1986 bp of the promoter region of *Arabidopsis* UBQ10 gene followed by an omega RBC translational enhancer creating pMTN3164 UBQ10_dCAS9_1xHA_2xNLS_5xGCN4 and pC1300 UBQ10_dCAS9_1xHA_2xNLS_5xGCN4. A second fragment containing 1986 bp of the promoter region of *Arabi-* dopsis UBQ10 gene will be cloned downstream of the 10XGCN4 in the pMTN3164 UBQ10_dCAS9_1xHA_2xNLS_5xGCN4 or pC1300 UBQ10_dCAS9_1xHA_2xNLS_5xGCN4 vectors followed by scFV, sfGFP, 1XHA tag, 2XNLS, and TET1-CD sequence that will be created through gene synthesis creating pMTN3164 UBQ10_dCAS9_1xHA_2xNLS_5xGCN4_UBQ10_scFV_sfGFP_1xHA_2xNLS_TET1CD and pC1300 UBQ10_dCAS9_1xHA_2xNLS_5xGCN4_UBQ10_scFV_sfGFP_1xHA_2xNLS_TET1CD. A gRNA cassette driven by a U6 promoter expressing a single gRNA will be inserted at the PmeI restriction site of pMTN3164 UBQ10_dCAS9_1xHA_2xNLS_5xGCN4_UBQ10_scFV_sfGFP_1xHA_2xNLS_TET1CD or pC1300 UBQ10_dCAS9_1xHA_2xNLS_5xGCN4_UBQ10_scFV_sfGFP_1xHA_2xNLS_TET1CD.

The exemplary expression cassette of UBQ10_dCAS9_1xHA_2xNLS_5xGCN4_UBQ10_scFV_sfGFP_1xHA_2xNLS_TET1-CD will contain a number of features. The nucleotide sequence of the expression cassette is presented in SEQ ID NO: 79. This cassette is described as a single cassette, but contains a number of different expression regions: (1) one that encodes a gRNA targeting the FWA promoter, (2) one that encodes the dCAS9-5xGCN4 fusion protein, and (3) one that encodes the scFv-TET1-CD fusion protein. The cassette includes U6::gRNA (SEQ ID NO: 80), a UBQ10 promoter (SEQ ID NO: 81), Omega RBC (SEQ ID NO: 82), dCAS9 (SEQ ID NO: 83), 1xHA (SEQ ID NO: 84), 2xNLS (SEQ ID NO: 85), linker (SEQ ID NO: 86), 5xGCN4 (SEQ ID NO: 87), OCS terminator (SEQ ID NO: 88), insulator (SEQ ID NO: 89), scFv (SEQ ID NO: 90), sfGFP (SEQ ID NO: 91), TET1-CD (SEQ ID NO: 92), and NOS terminator (SEQ ID NO: 93).

The amino acid sequence of the polypeptide fusion of dCAS9_1xHA_2xNLS_5xGCN4 is presented in SEQ ID NO: 94. Relevant amino acid sequences present in this fusion protein include, for example: dCAS9 (SEQ ID NO: 95), 1X HA (SEQ ID NO: 96), 2xNLS (SEQ ID NO: 97), linker (SEQ ID NO: 98), and 5xGCN4 (SEQ ID NO: 99).

The amino acid sequence of the polypeptide fusion of scFV_sfGFP_1xHA_2xNLS_TET1CD is presented in SEQ ID NO: 100. Relevant amino acid sequences present in this fusion protein include, for example: scFv (SEQ ID NO: 101), sfGFP (SEQ ID NO: 102), and TET1-CD (SEQ ID NO: 103).

A similar construct to the one above will also be constructed, but will contain 10xGCN4 (SEQ ID NO: 104), instead of 5xGCN4.

To target the FWA locus, various gRNA sequences will be tested, as presented in Table 4A.

Various gRNA sequences will also be present in a series of tRNA-gRNA expression cassettes. CRISPR-targeting technology involving tRNA-gRNA expression cassettes is described in Xie et al, PNAS (2015). This will allow for the delivery of multiple gRNAs simultaneously with high expression level.

TABLE 4A gRNA Molecules Targeting the FWA Promoter

| gRNA Name | crRNA Sequence (5' → 3') |
|---|---|
| gRNA3 | ATTCTCGACGGAAAGATGTA (SEQ ID NO: 171) |
| gRNA4 | ACGGAAAGATGTATGGGCTT (SEQ ID NO: 172) |

TABLE 4A-continued gRNA Molecules Targeting the FWA Promoter

| gRNA Name | crRNA Sequence (5' → 3') |
|---|---|
| gRNA12 | TTCATACGAGCGCCGCTCTA (SEQ ID NO: 173) |
| gRNA14 | CCATTGGTCCAAGTGCTATT (SEQ ID NO: 174) |
| gRNA16 | GCGGCGCAAGATCTGATATT (SEQ ID NO: 175) |
| gRNA17 | AAAACTAGGCCATCCATGGA (SEQ ID NO: 176) |

An appropriate crRNA sequence will be used in the gRNA structure described above (See SEQ ID NO: 80). FIG. 7 illustrates how various crRNA sequences and the flanking PAM sequence map to the FWA locus.

For tRNA-gRNA cassettes, one exemplary tRNA-gRNA expression cassette will contain two different gRNA molecules: gRNA4 and gRNA17. This cassette will be called U6p::tRNA-4-17, and the nucleotide sequence of this cassette is presented in SEQ ID NO: 46. Other features of this cassette include a U6 promoter (SEQ ID NO: 47), tRNA (SEQ ID NO: 48), gRNA backbone (SEQ ID NO: 49), and a PolIII terminator sequence (SEQ ID NO: 50).

Another exemplary tRNA-gRNA expression cassette will contain four different gRNA molecules: gRNA16, gRNA14, gRNA3, and gRNA17. This cassette will be called U6p::tRNA-16-14-3-17, and the nucleotide sequence of this cassette is presented in SEQ ID NO: 51. Other features of this cassette include a U6 promoter (SEQ ID NO: 47), tRNA (SEQ ID NO: 48), gRNA backbone (SEQ ID NO: 49), and a PolIII terminator sequence (SEQ ID NO: 50).

Transformation of Col-0 Plants

The construct described above will be transformed into Col-0 wild-type plants using Agrobacterium-mediated genetic transformation (after the construct is transformed into Agrobacterium). This process involves transforming plants via floral dip using methods well-known in the art.

Flowering Time Measurements

Progeny of transformed plants (T1s) will be planted and screened for BASTA-resistant plants that incorporate the T-DNA into the Arabidopsis genome, which confers resistance to BASTA. Among the BASTA-resistant transgenic plants, flowering time will be measured and compared to early-flowering wild-type Col-0 and late-flowering fwa-4 plants. Flowering time will be measured by counting the total number of leaves (rossette and cauline) of each individual plant.

Data Analysis

Plants transformed with the fusion constructs described above will be evaluated for phenotypic differences as compared to corresponding control plants (e.g. wild-type plants and fwa-4 plants) which are suggestive of successful targeting of the TET1 polypeptide to the locus of interest and subsequent de-methylation and/or transcriptional activation at the locus. The phenotype evaluated may vary depending on the locus targeted. Other analyses to be performed may include measuring the expression level of the targeted locus in the transformed plants, measuring the degree of DNA methylation at the targeted locus in the transformed plants (using e.g. bisulfite sequencing), or other assays well-known to those of skill in the art.

It is thought that the targeting scheme described in this Example will be able to successfully target a locus of interest and induce DNA de-methylation of the target locus.

Example 5: SunTag-Based Targeting of TET1 to FWA Locus

In the present Example, Applicant used the SunTag targeting scheme to target a TET1 polypeptide to the FWA locus in *Arabidopsis* using the CRISPR-CAS9 system.

Figure 9:
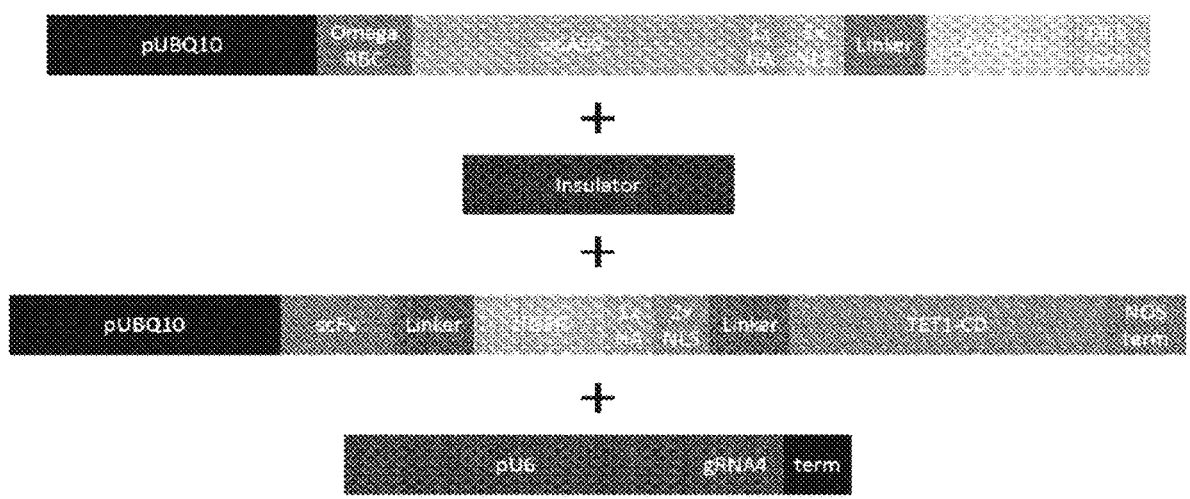
FIG. 9 illustrates a schematic of a SunTag targeting system that was used successfully to demethylate the FWA promoter.

Example 4 describes an exemplary SunTag-based targeting scheme to target a TET1 polypeptide to a target nucleic acid. This Example describes a successful SunTag targeting scheme in which a TET1 polypeptide was targeted to the FWA locus in *Arabidopsis* using the CRISPR-CAS9 system. A schematic of the targeting system is presented in FIG. 9.

Materials and Methods

Construction of gRNA4_U6_NOS_TET1CD_ 2xNLS_1xHA_sfGFP_scFv_UBQ10_INSULATOR_UBQ10_dCAS9_1xHA_3xNLS_10xGCN422aa_OCS and gRNA4_U6_NOS_TET1CD_2xNLS_1xHA_sfGFP_scFv_UBQ10_INSULATOR_UBQ10_dCAS9_1xHA_3xNLS_10xGCN414aa_OCS For this purpose, a dCAS9_1xHA_3xNLS_10xGCN4 that contains a 22aa spacer between epitopes (dCAS9_1xHA_3xNLS_10xGCN422aa) and a dCAS9_1xHA_3xNLS_10xGCN4 that contains a 14aa spacer between epitopes (dCAS9_1xHA_3xNLS_10xGCN414aa) were created through a combination of gene synthesis and the utilization of plasmids from Addgene, and separately cloned into a modified pMTN3164 plasmid downstream of a fragment containing 1986 bp of the promoter region of *Arabidopsis* UBQ10 gene followed by an omega RBC translational enhancer and upstream of a OCS terminator creating pMTN3164 UBQ10_dCAS9_1xHA_3xNLS_10xGCN422aa_OCS and pMTN3164 UBQ10_dCAS9_1xHA_3xNLS_10XGCN414aa_OCS. An insulator sequence followed by a second fragment containing 1986 bp of the promoter region of *Arabidopsis* UBQ10 gene was then cloned upstream of UBQ10_dCAS9_1xHA_3xNLS_10xGCN422aa_OCS and pMTN 3164 UBQ10_dCAS9_1xHA_3xNLS_10XGCN414aa_OCS such that transcription of downstream targets resulting from this second UBQ promoter would occur opposite the dCAS9_1xHA_3xNLS_10xGCN422aa or dCAS9_1xHA_3xNLS_10xGCN414aa transcription. A NOS terminator was then cloned downstream of this second UBQ10 promoter in both the UBQ10_INSULATOR_UBQ10_dCAS9_1xHA_3xNLS_10xGCN422aa_OCS and UBQ10_INSULATOR_UBQ10_dCAS9_1xHA_3xNLS_10xGCN414aa_OCS constructs creating pMTN3164 NOS_UBQ10_INSULATOR_UBQ10_dCAS9_1xHA_3xNLS_10xGCN422aa_OCS and pMTN3164 NOS_UBQ10_INSULATOR_UBQ10_dCAS9_1xHA_3xNLS_10xGCN414aa_OCS. A scFv_sfGFP_1XHA_2XNLS_TET1CD sequence created through a combination of gene synthesis and the utilization of plasmids from Addgene was then cloned downstream of the second UBQ10 promoter and upstream of the NOS terminator in both vectors creating pMTN3164 NOS_TET1CD_2xNLS_1xHA_sfGFP_scFv_UBQ10_INSULATOR_UBQ10_dCAS9_1xH A_3xNLS_10xGCN422aa_OCS and pMTN3164 NOS_TET1CD_2xNLS_1xHA_sfGFP_scFv_UBQ10_INSULATOR_UBQ10_dCAS9_1xH A_3xNLS_10xGCN414aa_OCS. For both vectors a gRNA4 cassette driven by a U6 promoter expressing a single gRNA4 was inserted at the PmeI restriction site of pMTN3164 downstream of the NOS terminator creating gRNA4_U6_NOS_TET1CD_2xNLS_1xHA_sfGFP_scFv_UBQ10_INSULATOR_UBQ10_dCAS9_1xHA_3xNLS_10xGCN422aa_OCS and gRNA4_U6_NOS_TET1CD_2xNLS_1xHA_sfGFP_scFv_UBQ10_INSULATOR_UBQ10_dCAS9_1xHA_3xNLS_10xGCN414aa_OCS.

The expression cassette of gRNA4_U6_NOS_TET1CD_2xNLS_1xHA_sfGFP_scFv_UBQ10_INSULATOR_UBQ10_dCAS9_1xHA_3xNLS_10xGCN422aa_OCS and gRNA4_U6_NOS_TET1CD_2xNLS_1xHA_sfGFP_scFv_UBQ10_INSULATOR_UBQ10_dCAS9_1xHA_3xNLS_10xGCN414aa_OCS differ only in the 10xGCN4 sequence. These vectors contain a number of features. The nucleotide sequence gRNA4_U6_NOS_TET1CD_2xNLS_1xHA_sfGFP_scFv_UBQ10_INSULATOR_UBQ10_dCAS9_1xHA_3xNLS_10xGCN422aa_OCS and gRNA4_U6_NOS_TET1CD_2xNLS_1xHA_sfGFP_scFv_UBQ10_INSULATOR_UBQ10_dCAS9_1xHA_3xNLS_10xGCN414aa_OCS expression cassettes are presented in SEQ ID NO: 105 and SEQ ID NO: 106, respectively. These cassettes are described as single cassettes, but contain many different expression regions: (1) one that encodes gRNA4 (See Example 4) targeting the FWA promoter, (2) one that encodes the dCAS9-10xGCN4 fusion protein, and (3) one that encodes the scFv-sfGFP-TET1-CD fusion protein. The cassette includes U6::gRNA4 (SEQ ID NO: 107), a UBQ10 promoter (SEQ ID NO: 108), Omega RBC (SEQ ID NO: 109), dCAS9 (SEQ ID NO: 110), 1xHA (SEQ ID NO: 111), 3xNLS (SEQ ID NO: 112), 2xNLS (SEQ ID NO: 113), linker (SEQ ID NO: 114), 10xGCN422aa (SEQ ID NO: 115) or 10xGCN414aa (SEQ ID NO: 116), OCS terminator (SEQ ID NO: 117), insulator (SEQ ID NO: 118), scFv (SEQ ID NO: 119), sfGFP (SEQ ID NO: 120), TET1-CD (SEQ ID NO: 121), and NOS terminator (SEQ ID NO: 122).

The amino acid sequence of the polypeptide fusion of dCAS9_1xHA_3xNLS_10xGCN422aa is presented in SEQ ID NO: 123 and amino acid sequence of the polypeptide fusion of dCAS9_1xHA_3xNLS_10xGCN414aa is presented in SEQ ID NO: 124. Relevant amino acid sequences present in these fusion proteins include, for example: dCAS9 (SEQ ID NO: 125), 1X HA (SEQ ID NO: 126), 3xNLS (SEQ ID NO: 127), linker (SEQ ID NO: 128), and 10xGCN422aa (SEQ ID NO: 129) or 10xGCN414aa (SEQ ID NO: 130).

The amino acid sequence of the polypeptide fusion of scFv_sfGFP_1xHA_2xNLS_TET1CD is presented in SEQ ID NO: 131 and is identical in both gRNA4_U6_NOS_TET1CD_2xNLS_1xHA_sfGFP_scFv_UBQ10_INSULATOR_UBQ10_dCAS9_1xHA_3xNLS_10xGCN422aa_OCS and gRNA4_U6_NOS_TET1CD_2xNLS_1xHA_sfGFP_scFv_UBQ10_INSULATOR_UBQ10_dCAS9_1xHA_3xNLS_10xGCN414aa_OCS vectors. Relevant amino acid sequences present in this fusion protein include, for example: scFv (SEQ ID NO: 132), sfGFP (SEQ ID NO: 133), 1xHA (SEQ ID NO: 134), 2xNLS (SEQ ID NO: 135), Linker (SEQ ID NO: 136), and TET1-CD (SEQ ID NO: 137).

Plant Transformation and Flowering Time Measurement

The constructs described above were transformed into Col-0 wild-type plants using *Agrobacterium*-mediated genetic transformation (after the construct was transformed into *Agrobacterium*). This process involves transforming plants via floral dip using methods well known in the art. Progeny of transformed plants (T1s) were screened for Hygromycin resistance. Among the Hygromycin-resistant transgenic plants, flowering time was measured and compared to early-flowering wild-type Col-0 and late-flowering fwa-4 plants. Flowering time was measured by counting the total number of leaves (rosette and cauline) of each individual plant.

Bisulfate Sequencing and Data Analysis

Whole genome bisulfite sequencing (BS-Seq) libraries were generated as previously reported (Cokus et al., 2008) and all libraries were sequenced using the HiSeq 2000 platform following manufacturer instructions (Illumina) at a length of 50 bp. BS-Seq reads were aligned to the TAIR10 version of the *Arabidopsis thaliana* reference genome using BS-map-2.74. For BS-Seq, up to 2 mismatches were allowed and only uniquely mapped reads were used.

RNA-Seq

Raw reads in qseq format obtained from the sequencer were first converted to fastq format with a customized perl script. Read quality was controlled with FastQC (http://www.bioinformatics.babraham.uk/projects/fastqc). High quality reads were then aligned to Tair10 reference genome using Tophat (Trapnell et al, 2009) (v 2.0.13) by using '-no-coverage-search' option, allowing up to two mismatches and only keeping reads that mapped to one location. Essentially, reads were first mapped to TAIR10 gene annotation with known splice junction. When reads did not map to the annotated genes, the reads were mapped to Tair10 genome. The number of reads mapping to genes were calculated by HTseq (Anders et al., 2015) (v 0.5.4) with default parameters. Expression levels were determined by RPKM (reads per kilobase of exons per million aligned reads) in R using customized scripts.

Results

To explore whether gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS can trigger demethylation and reactivate FWA expression, wild-type Col-0 plants were transformed with the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS construct described above. Flowering time of T1 transgenic plants was assayed, and results are presented below in Table 5A.

TABLE 5A

Flowering Time Results

| Line | Early Flowering | Late Flowering |
|---|---|---|
| gRNA4_U6_TET1CD_2xNLS_1xHA_sfGFP_scFv_UBQ10_INSULATOR_UBQ10_dCAS9_1xHA_3xNLS_10xGCN422aa | 7 | 2 |
| gRNA4_U6_NOS_TET1CD_2xNLS_1xHA_sfGFP_scFv_UBQ10_INSULATOR_UBQ10_dCAS9_1xHA_3xNLS_10xGCN414aa_OCS | 1 | 2 |

The results presented in Table 5A demonstrate that targeting the TET1 catalytic domain (TET1-CD) to the FWA locus using the SunTag system can efficiently promote late flowering in wild-type plants.

Figure 10:
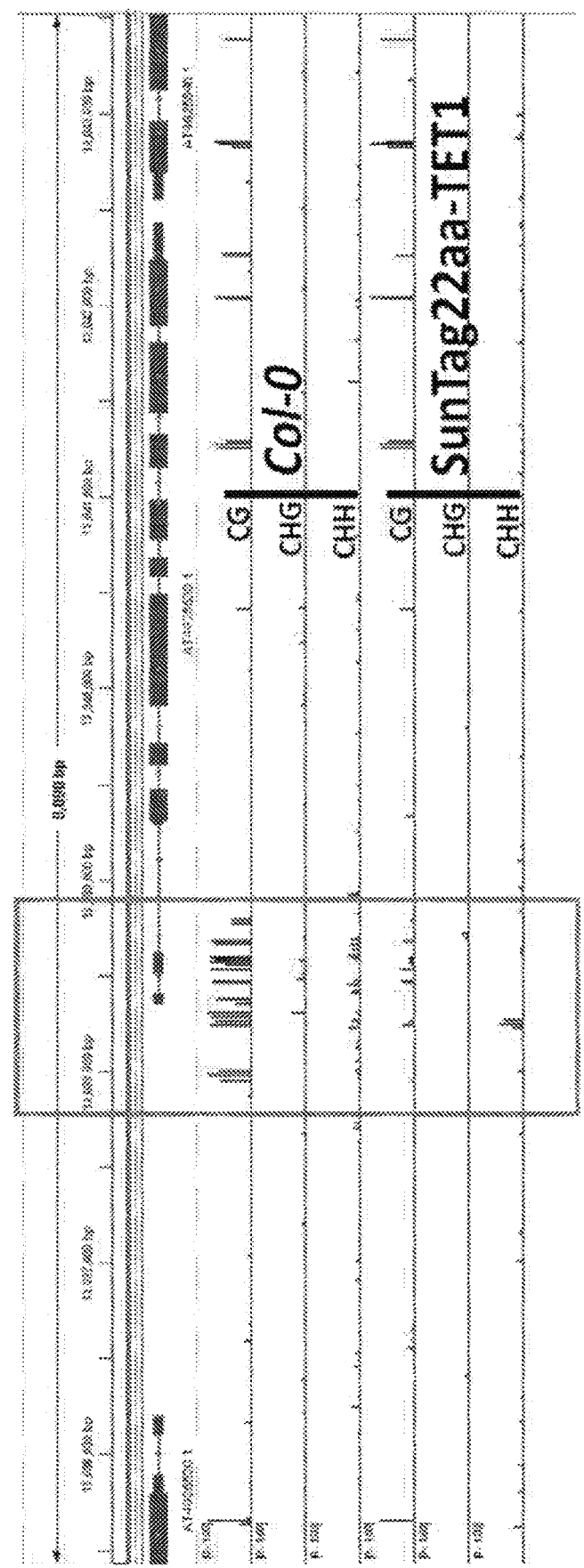
FIG. 10 illustrates illustrates Whole Genome Bisulfite Sequencing results. DNA methylation of a late flowering transgenic line that carries the gRNA4_U6_NOS_TET1CD_2xNLS_1xHA_sfGFP_scFv_UBQ10_INSULATOR_UBQ10_dCAS9_1xHA_3xNLS_10xGCN422aa_OCS (SunTag22aa-TET1) construct was analyzed by BS-seq. Methylation at different contexts (CG, CHG and CHH, where H is C, T, or A) is shown for a wild-type Col-0 plant and the SunTag-TET1 line. The FWA promoter region is marked in a red box.
Figure 11:
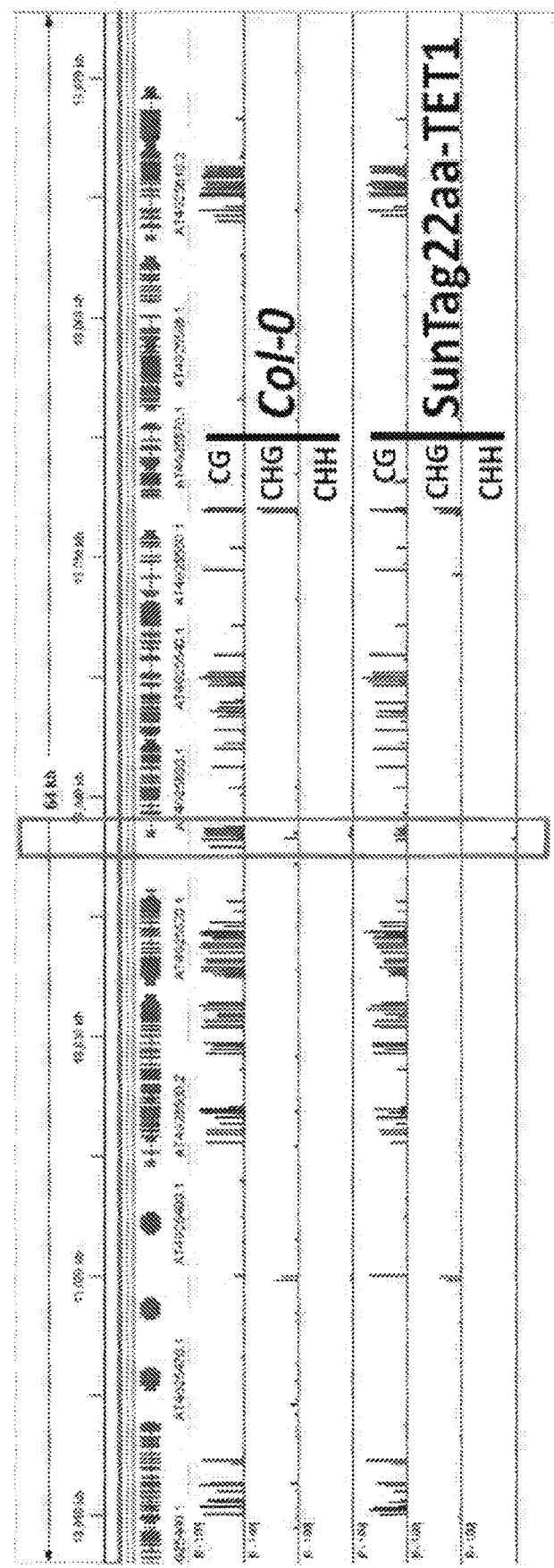
FIG. 11 illustrates a zoomed-out view of the Whole Genome Bisulfite Sequencing results presented in FIG. 10. DNA methylation of a late flowering transgenic line that carries the gRNA4_U6_NOS_TET1CD_2xNLS_1xHA_sfGFP_scFv_UBQ10_INSULATOR_UBQ10_dCAS9_1xHA_3xNLS_10xGCN422aa_OCS (SunTag22aa-TET1) construct was analyzed by BS-seq. Methylation at different contexts (CG, CHG and CHH, where H is C, T, or A) is shown for a wild-type Col-0 plant and the SunTag-TET1 line. The FWA promoter region is marked in a red box.
Figure 12:
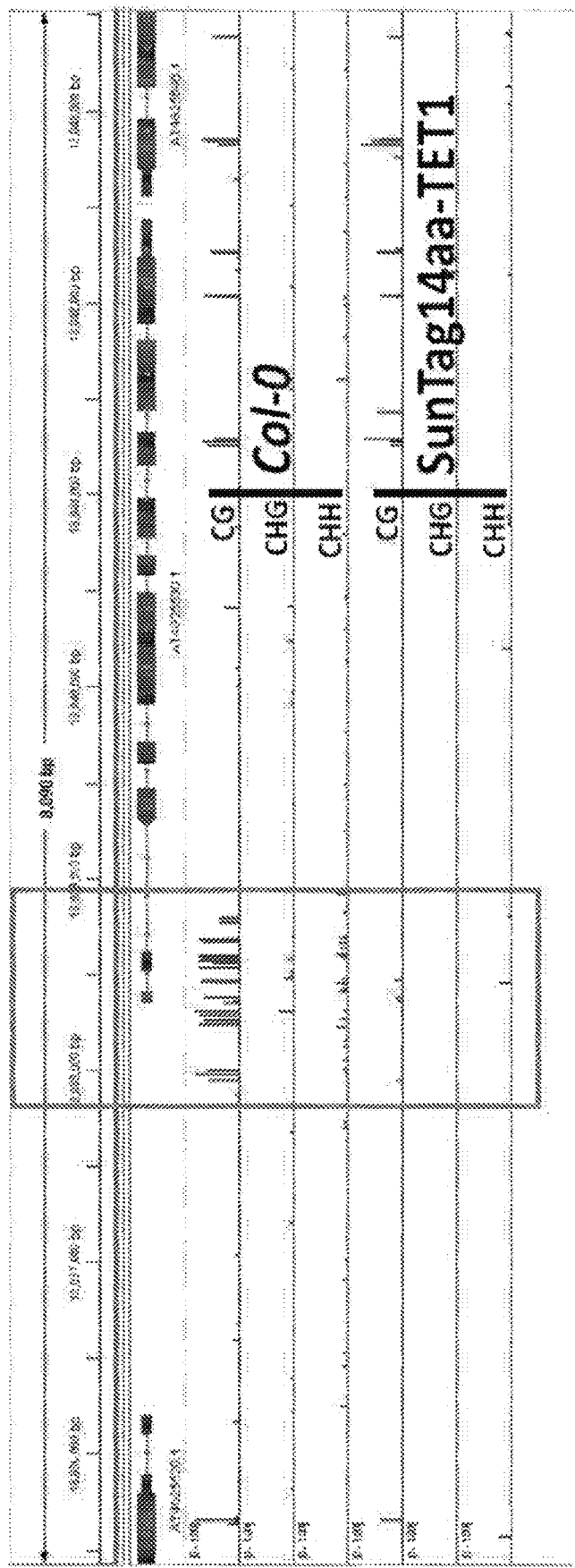
FIG. 12 illustrates Whole Genome Bisulfite Sequencing results. DNA methylation of a late flowering transgenic line that carries the gRNA4_U6_NOS_TET1CD_2xNLS_1xHA_sfGFP_scFv_UBQ10_INSULATOR_UBQ10_dCAS9_1xHA_3xNLS_10xGCN414aa_OCS (SunTag14aa-TET1) construct was analyzed by BS-seq. Methylation at different contexts (CG, CHG and CHH, where H is C, T, or A) is shown for a wild-type Col-0 plant and the SunTag-TET1 line. The FWA promoter region is marked in a red box.
Figure 13:
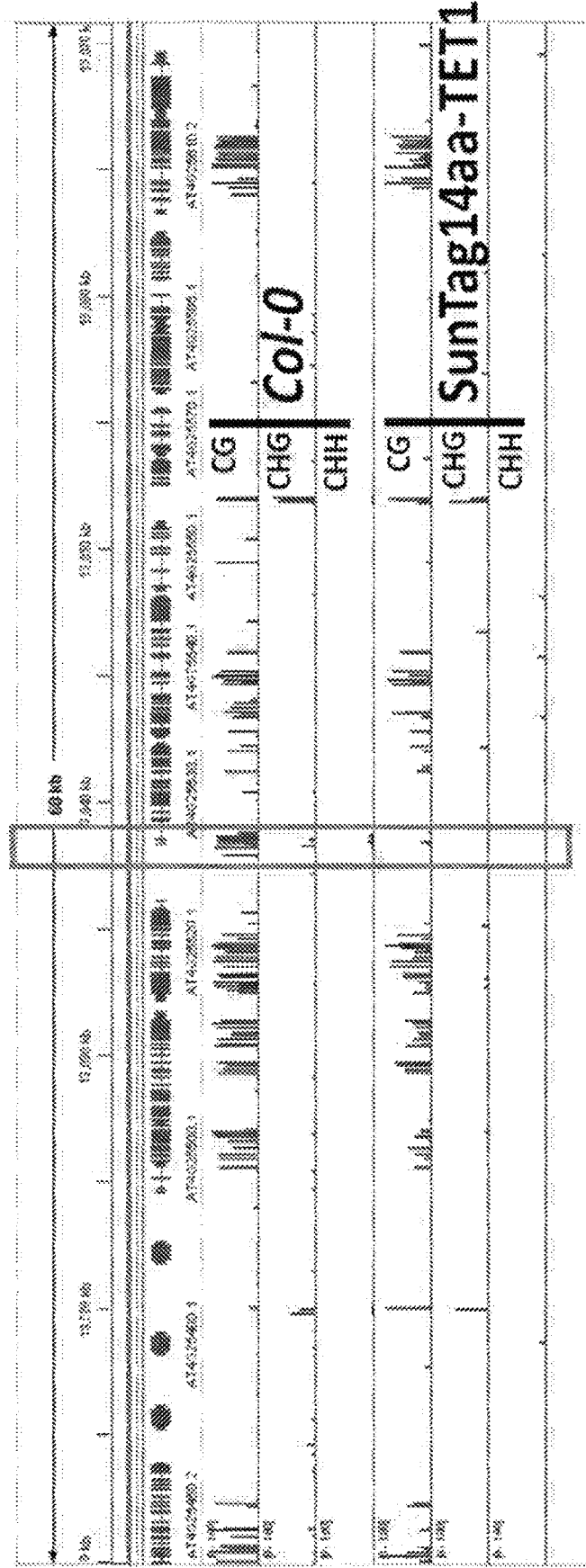
FIG. 13 illustrates a zoomed-out view of the Whole Genome Bisulfite Sequencing results presented in FIG. 12. DNA methylation of a late flowering transgenic line that carries the gRNA4_U6_NOS_TET1CD_2xNLS_1xHA_sfGFP_scFv_UBQ10_INSULATOR_UBQ10_dCAS9_1xHA_3xNLS_10xGCN414aa_OCS (SunTag14aa-TET1) construct was analyzed by BS-seq. Methylation at different contexts (CG, CHG and CHH, where H is C, T, or A) is shown for a wild-type Col-0 plant and the SunTag-TET1 line. The FWA promoter region is marked in a red box.

To test if the late flowering phenotype of plants containing the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS construct describe in Table 5A is due to the loss of methylation in the FWA promoter, whole-genome BS-Seq experiments were conducted as described above. The results, presented in FIG. 10 and FIG. 11 for plants containing the gRNA4_U6_NOS_TET1CD_2xNLS_1xHA_sfGFP_scFv_UBQ10_INSULATOR_UBQ10_dCAS9_1xHA_3xNLS_10xGCN422aa_OCS construct and FIG. 12 and FIG. 13 for plants containing the gRNA4_U6_NOS_TET1CD_2xNLS_1xHA_sfGFP_scFv_UBQ10_INSULATOR_UBQ10_dCAS9_1xHA_3xNLS_10xGCN414aa_OCS construct, show a loss of methylation in the FWA promoter in backgrounds that contain the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS constructs and that this demethylation was specific to the FWA promoter (FIG. 11 and FIG. 13).

Figure 14:
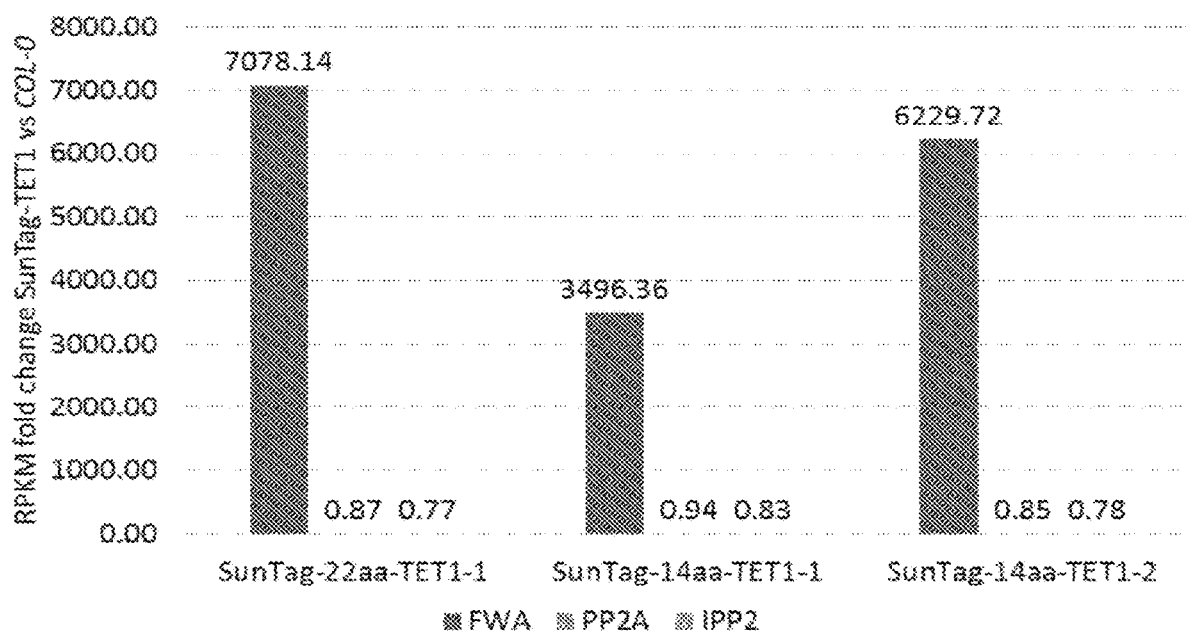
FIG. 14 illustrates RNA-seq analysis of Col-0 wild-type plants and one independent T1 line for the gRNA4_U6_NOS_TET1CD_2xNLS_1xHA_sfGFP_scFv_UBQ10_INSULATOR_UBQ10_dCAS9_1xHA_3xNLS_10xGCN422aa_OCS (SunTag22aa-TET1-1) and two independent T1 lines for the gRNA4_U6_NOS_TET1CD_2xNLS_1xHA_sfGFP_scFv_UBQ10_INSULATOR_UBQ10_dCAS9_1xHA_3xNLS_10xGCN414aa_OCS (SunTag14aa-TET1-1 and SunTag14aa-TET1-2) construct. SunTag22aa-TET1, SunTag14aa-TET1 and wild-type Col-0 control plants were analysed by RNA-seq. RPKM fold change between wild-type Col-0 and SunTag22aa-TET1-1, SunTag14aa-TET1-1 or SunTag14aa-TET1-1 is presented for the FWA gene and the control housekeeping genes PP2A and IPP2. The fold change value in expression of each gene in the indicated line as compared to Col-0 wild-type plants is indicated on top of each bar.

To test if the late flowering observed in gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS lines were due to the activation of FWA expression, RNA-seq was performed with one independent T1 line for gRNA4_U6_NOS_TET1CD_2xNLS_1xHA_sfGFP_scFv_UBQ10_INSULATOR_UBQ10 dCAS9_1xHA_3xNLS_10xGCN422aa_OCS and two independent T1 lines for gRNA4_U6_NOS_TET1CD_2xNLS_1xHA_sfGFP_scFv_UBQ10_INSULATOR_UBQ10_dCAS9_1xHA_3xNLS_10xGCN414aa_OCS. The results presented in FIG. 14 show that FWA was upregulated in all transgenic lines tested compared to expression in Col-0 wild type plants while two control housekeeping genes remained unaffected.

The results presented in this Example demonstrate that the specific targeting of the TET1 catalytic domain to a genomic region of interest can be used to target demethylation and gene activation in plants in a very specific manner.

Example 6: SunTag-Based Targeting of TET1 to the CACTA1 Locus

In the present Example, Applicant used the SunTag targeting scheme to target a TET1 polypeptide to the CACTA1 locus in *Arabidopsis* using the CRISPR-CAS9 SunTag system.

Figure 15:
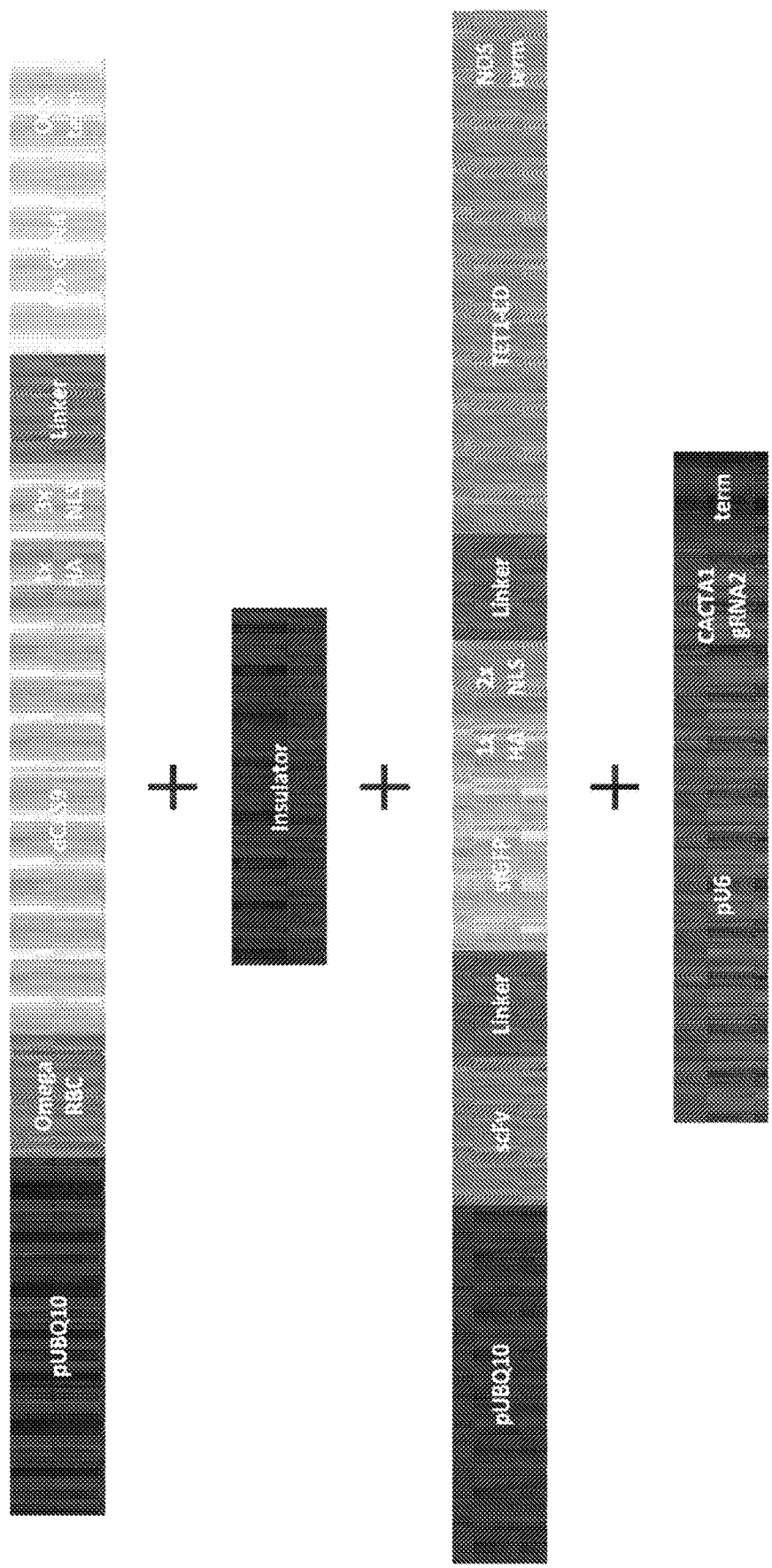
FIG. 15 illustrates a schematic of a SunTag targeting system that was used successfully to demethylate the CACTA1 promoter.

Example 4 describes an exemplary SunTag-based targeting scheme to target a TET1 catalytic polypeptide to a target nucleic acid. This Example describes a successful SunTag targeting scheme in which a TET1 polypeptide was targeted to the CACTA1 locus in *Arabidopsis* using the CRISPR-CAS9 system. A schematic of the targeting system is presented in FIG. 15.

Materials and Methods

Construction of CACTA1gRNA2_U6_NOS_TET1CD_2xNLS_1xHA_sfGFP_scFv_UBQ10_INSULATOR_UBQ10_dCAS9_1xHA_3xNLS_10xGCN422aa_OCS For this purpose, a dCAS9_1xHA_3xNLS_10xGCN4 that contains a 22aa spacer between epitopes (dCAS9_1xHA_3xNLS_10xGCN422aa) was created through a combination of gene synthesis and the utilization of plasmids from Addgene and separately cloned into a modified pMTN3164 (also called pMOA) plasmid downstream of a fragment containing 1994 bp of the promoter region of the *Arabidopsis* UBQ10 gene followed by an omega RBC translational enhancer and upstream of an OCS terminator creating pMTN3164 UBQ10_dCAS9_ 1xHA_3xNLS_10xGCN422aa_OCS. An insulator sequence followed by a second fragment containing 1986 bp of the promoter region of the *Arabidopsis* UBQ10 gene was then cloned upstream of UBQ10_dCAS9_1xHA_ 3xNLS_10xGCN422aa_OCS such that transcription of downstream targets resulting from this second UBQ10 promoter would occur opposite the dCAS9_ 1xHA_3xNLS_10xGCN422aa transcription. Sequences created through a combination of gene synthesis and the utilization of plasmids from Addgene were then cloned downstream of the second UBQ10 promoter creating pMTN3164 TET1CD_2xNLS_1xHA_sfGFP_scFv_ UBQ10_INSULATOR_UBQ10_dCAS9_1xHA_3x NLS_ 10xGCN422aa_OCS. A NOS terminator was then cloned downstream of TET1cd in the TET1CD_2xNLS_ 1xHA_sfGFP_scFv_UBQ10_INSULATOR_UBQ10_ dCAS9_1xHA_3x NLS_10xGCN422aa_OCS construct creating pMTN3164 NOS_TET1CD_2xNLS_1xHA_ sfGFP_scFv_UBQ10_INSULATOR_UBQ10_dCAS9_1xH A_3xNLS_10xGCN422aa_OCS. A CACTA1gRNA2 cassette driven by a U6 promoter expressing a single CACTA1gRNA2 was inserted at the PmeI restriction site of pMTN3164 downstream of the NOS terminator creating CACTA1gRNA2_U6_NOS_TET1CD_2xNLS_1xHA_ sfGFP_scFv_UBQ10_INSULATOR_UBQ10_dCAS9_ 1xHA_3xNLS_10xGCN422aa_OCS.

The expression cassette of CACTA1gRNA2_U6_ NOS_TET1CD_2xNLS_1xHA_sfGFP_scFv_UBQ10_ INSULATOR_UBQ10_dCAS9_1xHA_3xNLS_10xGCN 422aa_OCS contains a number of features. The nucleotide sequence of the CACTA1gRNA2_U6_NOS_TET1CD_ 2xNLS_1xHA_sfGFP_scFv_UBQ10_INSULATOR_ UBQ10_dCAS9_1xHA_3xNLS_10xGCN422aa_OCS expression cassette is presented in SEQ ID NO: 142. This cassette is described as a single cassette, but contains many different expression regions: (1) one that encodes CACTA1gRNA2 targeting the CACTA1 promoter, (2) one that encodes the dCAS9-10xGCN4 fusion protein, and (3) one that encodes the scFv-sfGFP-TET1-CD fusion protein. The cassette includes U6:: CACTA1gRNA2 (SEQ ID NO: 143), a UBQ10 promoter (SEQ ID NO: 108), Omega RBC (SEQ ID NO: 109), dCAS9 (SEQ ID NO: 110), 1xHA (SEQ ID NO: 111), 3xNLS (SEQ ID NO: 112), 2xNLS (SEQ ID NO: 113), linkers (SEQ ID NO: 114), 10xGCN422aa (SEQ ID NO: 115), OCS terminator (SEQ ID NO: 117), insulator (SEQ ID NO: 118), scFv (SEQ ID NO: 119), sfGFP (SEQ ID NO: 120), TET1-CD (SEQ ID NO: 121), and NOS terminator (SEQ ID NO: 122).

The amino acid sequence of the polypeptide fusion of dCAS9_1xHA_3xNLS_10xGCN422aa is presented in SEQ ID NO: 123. Relevant amino acid sequences present in these fusion proteins include, for example: dCAS9 (SEQ ID NO: 125), 1X HA (SEQ ID NO: 126), 3xNLS (SEQ ID NO: 127), linker (SEQ ID NO: 128), and 10xGCN422aa (SEQ ID NO: 129).

The amino acid sequence of the polypeptide fusion of scFv_sfGFP_1xHA_2xNLS_TET1CD is presented in SEQ ID NO: 131. Relevant amino acid sequences present in this fusion protein include, for example: scFv (SEQ ID NO: 132), sfGFP (SEQ ID NO: 133), 1xHA (SEQ ID NO: 134), 2xNLS (SEQ ID NO: 135), Linkers (SEQ ID NO: 136), and TET1-CD (SEQ ID NO: 137).

Plant Transformation

The constructs described above were transformed into Col-0 wild-type plants using *Agrobacterium*-mediated genetic transformation (after the construct was transformed into *Agrobacterium*). This process involves transforming plants via floral dip using methods well known in the art. Progeny of transformed plants (T1s) were screened for Hygromycin resistance.

Bisulfate Sequencing and Data Analysis

Whole genome bisulfite sequencing (BS-Seq) libraries were generated as previously reported (Cokus et al., 2008) and all libraries were sequenced using the HiSeq 4000 platform following manufacturer instructions (Illumina) at a length of 50 bp. BS-Seq reads were aligned to the TAIR10 version of the *Arabidopsis thaliana* reference genome using BS-map-2.74. For BS-Seq, up to 2 mismatches were allowed and only uniquely mapped reads were used.

Metaplot of WGBS Data

Metaplots of WGBS data were made using custom Perl and R scripts. Regions of interest were broken into 50 bins while flanking 1 kb regions were each broken into 25 bins. CG, CHG and CHH methylation levels in each bin were then determined. Metaplots were then generated with R.

Quantitative Real-Time PCR

Among the Hygromycin-resistant transgenic plants, CACTA1 gene expression was measured and compared to CACTA1 gene expression in wild-type Col-0. Gene expression was measured by performing quantitative Real-time PCR (qPCR) of each individual plant. qPCR was done using the oligos (5'-agtgtttcaatcaaggcgtttc-3') (SEQ ID NO: 177) and (5'-cacccaatggaacaaagtgaac-3') (SEQ ID NO: 178) to amplify a region of the CACTA1 gene. As an internal control, CACTA1 expression values were normalized to the expression of the IPP2 housekeeping gene collected from the same sample using oligos (5'-gtatgagttgcttctccagcaaag-3') (SEQ ID NO: 179) and (5'-gaggatggctgcaacaagtgt-3') (SEQ ID NO: 180).

Results

To explore if CACTA1gRNA2_U6_NOS_TET1CD_ 2xNLS_1xHA_sfGFP_scFv_UBQ10_INSULATOR_ UBQ10_dCAS9_1xHA_3xNLS_10xGCN422aa_OCS can trigger demethylation and reactivate CACTA1 expression, wild-type Col-0 plants were transformed with the CACTA1gRNA2_U6_NOS_TET1CD_2xNLS_1xHA_ sfGFP_scFv_UBQ10_INSULATOR_UBQ10_dCAS9_ 1xHA_3xNLS_10xGCN422aa_OCS construct described above. CACTA1 expression was assayed using qPCR. The results presented in FIG. 16 demonstrate that targeting the TET1 catalytic domain (TET1-CD) to the CACTA1 locus using the SunTag system can efficiently reactivate CACTA1 expression.

Figure 16:
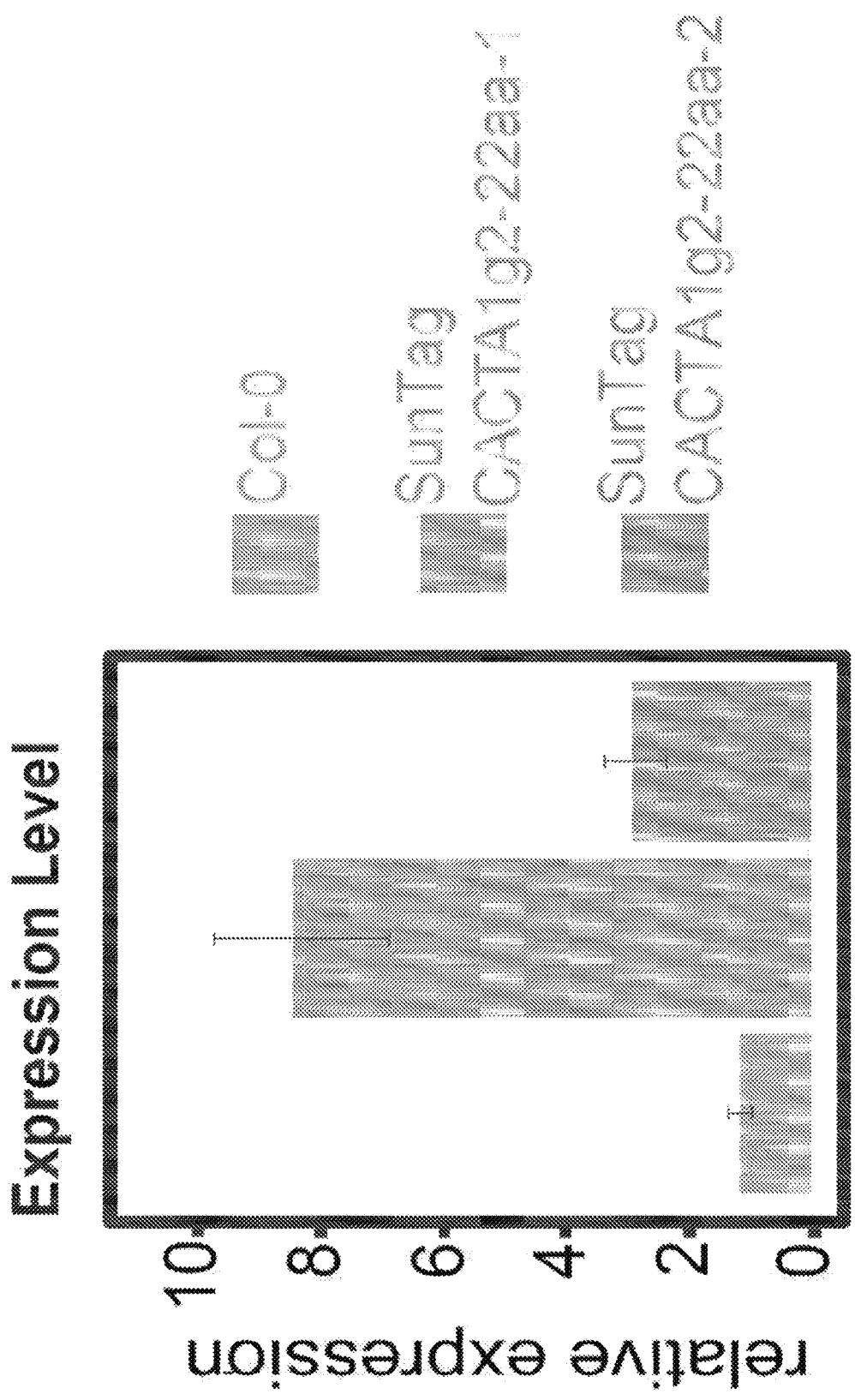
FIG. 16 illustrates quantitative real-time PCR results in a bar graph showing relative expression of CACTA1 over IPP2 in Col-0 and two T1 plants containing the CACTA1gRNA2_U6_NOS_TET1CD_2xNLS_1xHA_sfGFP_scFv_UBQ10_INSULATOR_UBQ10_dCAS9_1xHA_3xNLS_10xGCN422aa_OCS (SunTagCACTA1g2-22aa) transgene.
Figure 17:
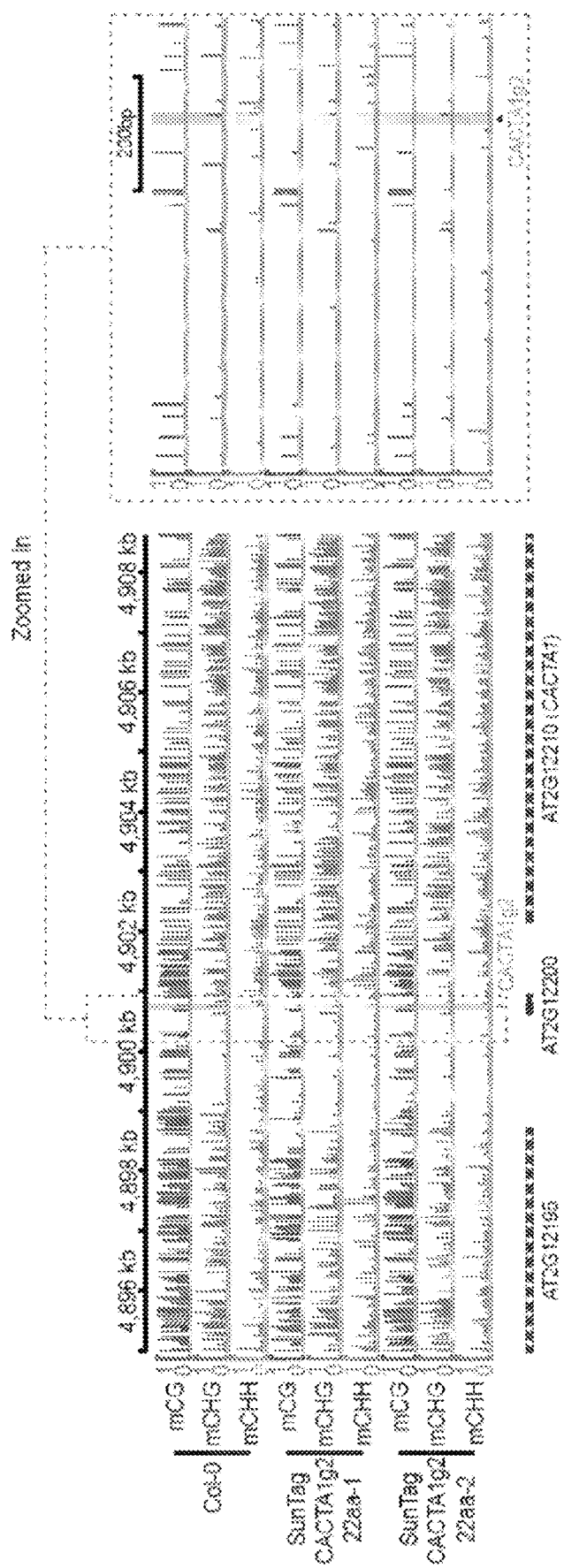
FIG. 17 illustrates Whole Genome Bisulfite Sequencing results. DNA methylation of two independent transgenic lines that carry the CACTA1gRNA2_U6_NOS_TET1CD_2xNLS_1xHA_sfGFP_scFv_UBQ10_INSULATOR_UBQ10_dCAS9_1xHA_3xNLS_10xGCN422aa_OCS (SunTagCACTA1g2-22aa) transgene were analyzed by BS-seq. Methylation levels in different contexts (CG, CHG and CHH, where H is C, T, or A) are shown for a wild-type Col-0 plant and the SunTag22aaCACTA1g2-22aa lines. A gray arrow indicates the gRNA binding site in the promoter region of CACTA1. A zoom in of the targeted region is shown (right).
Figure 18:
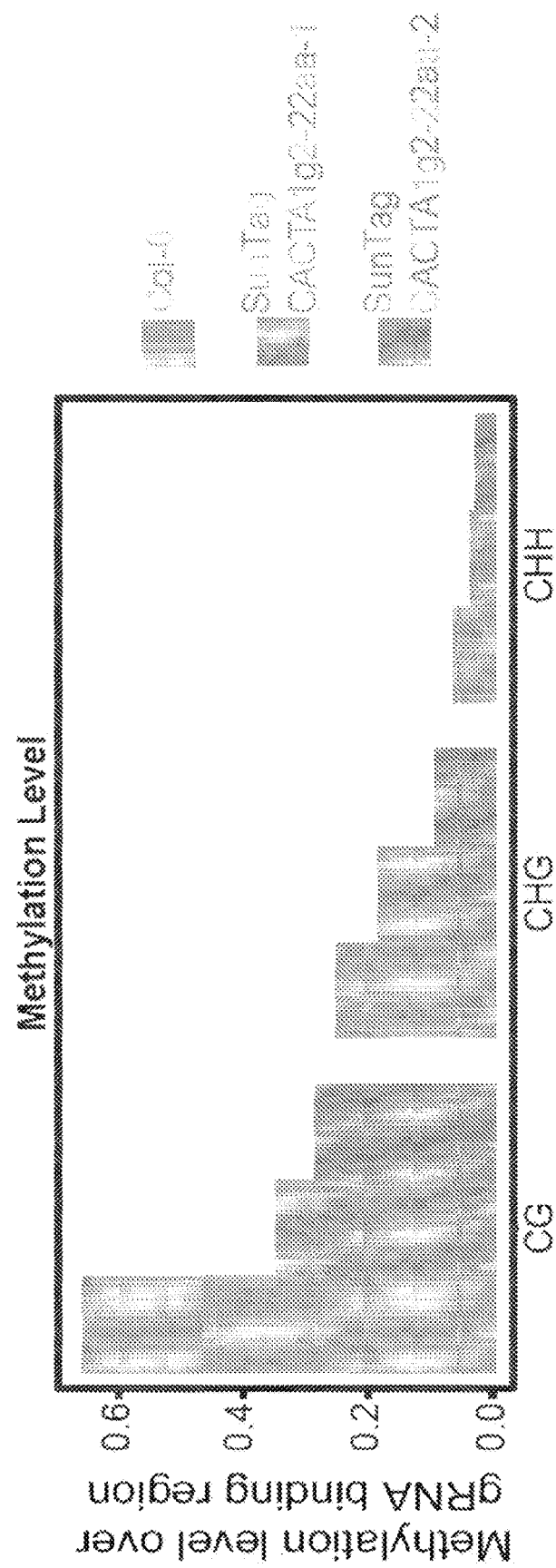
FIG. 18 illustrates the methylation levels in the region comprising 200 bp upstream and downstream of the gRNA binding site in a bar graph for Col-0 and two T1 plants containing CACTA1gRNA2_U6_NOS_TET1CD_2xNLS_ 1xHA_sfGFP_scFv_UBQ10_INSULATOR_UBQ10_ dCAS9_1xHA_3xNLS_10xGCN422aa_OCS (SunTagCACTA1g2-22aa) transgene.

To test if reactivation of CACTA1 expression in plants containing the CACTA1gRNA2_U6_NOS_TET1CD_ 2xNLS_1xHA_sfGFP_scFv_UBQ10_INSULATOR_ UBQ10_dCAS9_1xHA_3xNLS_10xGCN422aa_OCS transgene described in FIG. 16 is due to the loss of methylation in the CACTA1 promoter, BS-Seq experiments were conducted as described above. The results, presented in FIG. 17 and FIG. 18, show a loss of methylation in the CACTA1 promoter in backgrounds that contains the CACTA 1gRNA2_U6_NOS_TET1CD_2xNLS_1xHA_sfGFP_ scFv_UBQ10_INSULATOR_UBQ10_dCAS9_1xHA_ 3xNLS_10xGCN422aa_OCS transgene, and show that this demethylation was specific to the CACTA1 promoter (FIG. 17 and FIG. 18), as regions flanking CACTA1 were mostly unaffected.

Figure 19:
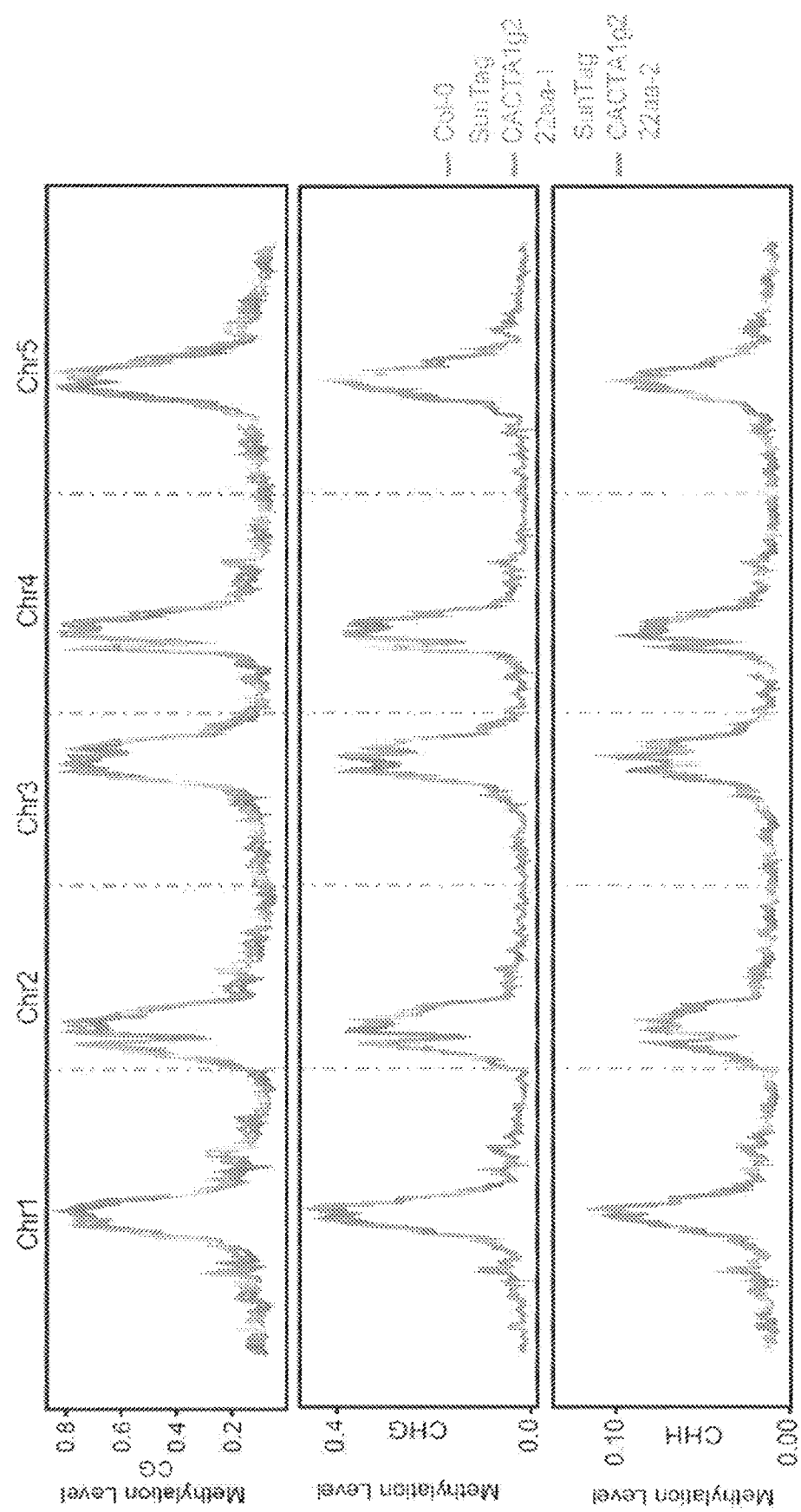
FIG. 19 illustrates the genome-wide CG, CHG and CHH methylation levels in Col-0 and two T1 plants containing the CACTA1gRNA2_U6_NOS_TET1CD_2xNLS_1xHA_ sfGFP_scFv_UBQ10_INSULATOR_UBQ10_dCAS9_ 1xHA_3xNLS_10xGCN422aa_OCS (SunTagCACTA1g2-22aa) transgene. Percent methylation is depicted on the Y-axis.

To test the specificity of the targeted demethylation caused by the expression of the CACTA1 gRNA2_U6_NOS_TET1CD_2xNLS_1xHA_sfGFP_scFv_ UBQ10_INSULATOR_UBQ10_dCAS9_1xHA_3xNLS_ 10xGCN422aa_OCS transgene in T1 plants, genome-wide methylation levels were checked and compared with that of a Col-0 control plant. The results presented in FIG. 19 show that genome-wide DNA methylation levels were similar among all backgrounds examined, indicating that the TET1 fusion was specifically acting at its target.

The results presented in this Example demonstrate that the specific targeting of the TET1 catalytic domain to a genomic region of interest by the SunTag targeting scheme can be used to target demethylation and gene activation in plants in a very specific manner. This system can thus be used to study the role of DNA methylation at specific loci without the need for mutants or chemicals that impair genome-wide methylation levels. The successful demethylation of the promoter region of CACTA1 indicates that other TEs may also be amenable to targeted demethylation, which enables the exploration of the effects of TE activity upon genome integrity, as well as the reactivation of TEs for mutagenesis.

Example 7: SunTag-Based Targeting of TET1 to the ROS1 Locus

In the present Example, Applicant used the SunTag targeting scheme to target a TET1 polypeptide to the ROS1 locus in *Arabidopsis* using the CRISPR-CAS9 system.

Example 4 describes an exemplary SunTag-based targeting scheme to target a TET1 polypeptide to a target nucleic acid. This Example describes a successful SunTag targeting scheme in which a TET1 polypeptide was targeted to the ROS1 locus in *Arabidopsis* using the CRISPR-CAS9 system. A schematic of the targeting system is presented in FIG. 20.

Materials and Methods

Construction of ROS1gRNA2_U6_NOS_TET1CD_ 2xNLS_1xHA_sfGFP_scFv_UBQ10_INSULA TOR_UBQ 10_dCAS9_1xHA_3xNLS_10xGCN422aa_OCS For this purpose, a dCAS9_1xHA_3xNLS_10xGCN4 that contains a 22aa spacer between epitopes (dCAS9_1xHA_3xNLS_10xGCN422aa) was created through a combination of gene synthesis and the utilization of plasmids from Addgene and separately cloned into a modified pMTN3164 plasmid downstream of a fragment containing 1994 bp of the promoter region of the *Arabidopsis* UBQ10 gene followed by an omega RBC translational enhancer and upstream of an OCS terminator creating pMTN3164 UBQ10_dCAS9_1xHA_3xNLS_10xGCN 422aa_OCS. An insulator sequence followed by a second fragment containing 1994 bp of the promoter region of the *Arabidopsis* UBQ10 gene was then cloned upstream of UBQ10_dCAS9_1xHA_3xNLS_10xGCN422aa_OCS such that transcription of downstream targets resulting from this second UBQ10 promoter would occur opposite the dCAS9_1xHA_3xNLS_10xGCN422aa transcription. A scFv_sfGFP_1XHA_2XNLS_TET1CD sequence created through a combination of gene synthesis and the utilization of plasmids from Addgene was then cloned downstream of the second UBQ10 promoter creating pMTN3164 TET1CD_2xNLS_1xHA_sfGFP_scFv_UBQ10_INSULA- TOR_UBQ10_dCAS9_1xHA_3x NLS_10xGCN422aa_ OCS. A NOS terminator was then cloned downstream of TET1cd in the TET1CD_2xNLS_1xHA_sfGFP_ scFv_UBQ10_INSULATOR_UBQ10_dCAS9_1xHA_3x NLS_10xGCN422aa_OCS construct creating pMTN3164 NOS_TET1CD_2xNLS_1xHA_sfGFP_scFv_UBQ10_ INSULATOR_UBQ10_dCAS9_1xH A_3xNLS_10xGCN 422aa_OCS. A ROS1gRNA2 cassette driven by a U6 promoter expressing a single ROS1gRNA2 was inserted at the PmeI restriction site of pMTN3164 downstream of the NOS terminator creating ROS1gRNA2_U6_NOS_TET1CD_ 2xNLS_1xHA_sfGFP_scFv_UBQ10_INSULATOR_UBQ 10_dCAS9_1xHA_3xNLS_10xGCN422aa_OCS.

The ROS1gRNA2_U6_NOS_TET1CD_2xNLS_1xHA_ sfGFP_scFv_UBQ10_INSULATOR_UBQ10_dCAS9_ 1xHA_3xNLS_10xGCN422aa_OCS vector contains a number of features. The nucleotide sequence of of the ROS1 gRNA2_U6_NOS_TET1CD_2xNLS_1xHA_sfGFP_scFv_ UBQ10_INSULATOR_UBQ10_dCAS9_1xHA_3xNLS_ 10xGCN422aa_OCS expression cassette is presented in SEQ ID NO: 144. This cassette is described as a single cassette, but contains many different expression regions: (1) one that encodes ROS1gRNA2 targeting the ROS1 promoter, (2) one that encodes the dCAS9-10xGCN4 fusion protein, and (3) one that encodes the scFv-sfGFP-TET1-CD fusion protein. The cassette includes U6::ROS1gRNA2 (SEQ ID NO: 145), a UBQ10 promoter (SEQ ID NO: 108), Omega RBC (SEQ ID NO: 109), dCAS9 (SEQ ID NO: 110), 1xHA (SEQ ID NO: 111), 3xNLS (SEQ ID NO: 112), 2xNLS (SEQ ID NO: 113), linkers (SEQ ID NO: 114), 10xGCN422aa (SEQ ID NO: 115), OCS terminator (SEQ ID NO: 117), insulator (SEQ ID NO: 118), scFv (SEQ ID NO: 119), sfGFP (SEQ ID NO: 120), TET1-CD (SEQ ID NO: 121), and NOS terminator (SEQ ID NO: 122).

The amino acid sequence of the polypeptide fusion of dCAS9_1xHA_3xNLS_10xGCN422aa is presented in SEQ ID NO: 123. Relevant amino acid sequences present in these fusion proteins include, for example: dCAS9 (SEQ ID NO: 125), 1X HA (SEQ ID NO: 126), 3xNLS (SEQ ID NO: 127), linker (SEQ ID NO: 128), and 10xGCN422aa (SEQ ID NO: 129).

The amino acid sequence of the polypeptide fusion of scFv_sfGFP_1xHA_2xNLS_TET1CD is presented in SEQ ID NO: 131. Relevant amino acid sequences present in this fusion protein include, for example: scFv (SEQ ID NO: 132), sfGFP (SEQ ID NO: 133), 1xHA (SEQ ID NO: 134), 2xNLS (SEQ ID NO: 135), Linkers (SEQ ID NO: 136), and TET1-CD (SEQ ID NO: 137).

Plant Transformation

The construct described above was transformed into Col-0 wild-type plants using *Agrobacterium*-mediated genetic transformation (after the construct was transformed into *Agrobacterium*). This process involves transforming plants via floral dip using methods well known in the art. Progeny of transformed plants (T1s) were screened for Hygromycin resistance.

Quantitative Real-Time PCR

Among the Hygromycin-resistant transgenic plants, ROS1 gene expression was measured and compared to ROS1 gene expression in wild-type Col-0. Gene expression was measured by performing Quantitative Real-time PCR (qPCR) of each individual plant. qPCR was done using the oligos (5'-caggcttgcttttggaaagggtacg-3') (SEQ ID NO: 181) and (5'-gtgctctctcactcttaaccataagct-3') (SEQ ID NO: 182) to amplify a region of the ROS1 gene. As an internal control ROS1 expression values were normalized to the expression of the IPP2 housekeeping gene collected from the same sample using oligos (5'-gtatgagttgcttctccagcaaag-3') (SEQ ID NO: 183) and (5'-gaggatggctgcaacaagtgt-3') (SEQ ID NO: 184).

Bisulfate Sequencing and Data Analysis

Whole genome bisulfite sequencing (BS-Seq) libraries were generated as previously reported (Cokus et al., 2008) and all libraries were sequenced using the HiSeq 4000 platform following manufacturer instructions (Illumina) at a length of 50 bp. BS-Seq reads were aligned to the TAIR10 version of the *Arabidopsis thaliana* reference genome using BS-map-2.74. For BS-Seq, up to 2 mismatches were allowed and only uniquely mapped reads were used.

Results

Figure 21:
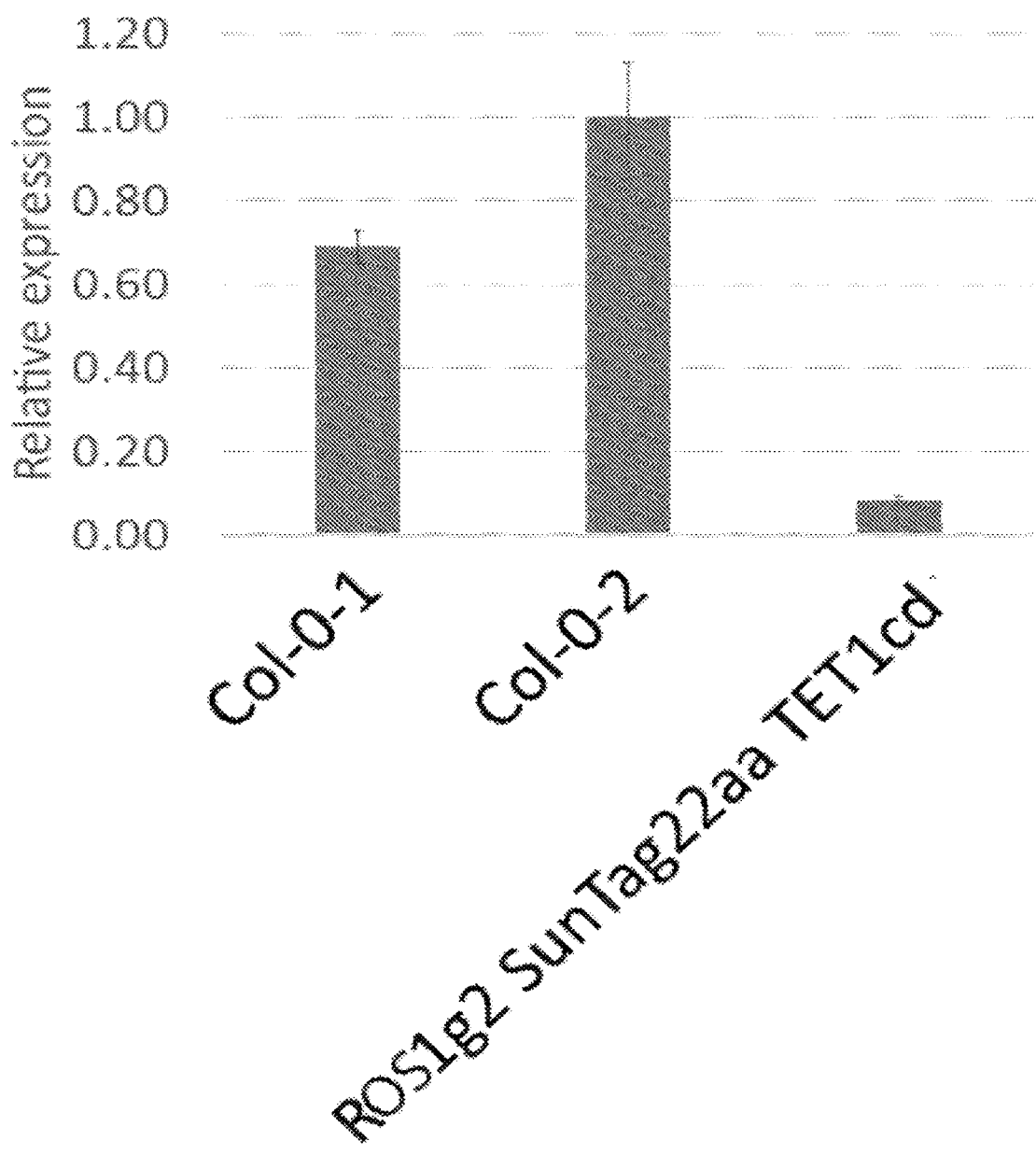
FIG. 21 illustrates quantitative real-time PCR results in a bar graph showing relative expression of ROS1 over IPP2 in two Col-0 and one transgenic plant containing the ROS1gRNA2_U6_NOS_TET1CD_2xNLS_1xHA_sfGFP_ scFv_UBQ10_INSULATOR_UBQ10_dCAS9_1xHA_ 3xNLS_10xGCN422aa_OCS (ROS1g2 SunTag22aa TET1cd) transgene.

ROS1 is an example of a gene whose expression depends on DNA methylation. Methylation mutants with lower DNA methylation in the ROS1 promoter show reduced ROS1 expression (Lei M, et al. (2015) Regulatory link between DNA methylation and active demethylation in *Arabidopsis*. *Proc Natl Acad Sci* 112(11):3553-3557; Williams B P, Pignatta D, Henikoff S, Gehring M (2015) Methylation-Sensitive Expression of a DNA Demethylase Gene Serves As an Epigenetic Rheostat. *PLoS Genet* 11(3):1-18.). To explore if ROS1gRNA2_U6_NOS_TET1CD_2xNLS_ 1xHA_sfGFP_scFv_UBQ10_INSULATOR_UBQ10_ dCAS9_1xHA_3xNLS_10xGCN422aa_OCS can trigger demethylation and repress ROS1 expression, wild-type Col-0 plants were transformed with the ROS1 gRNA2_U6_NOS_TET1CD_2xNLS_1xHA_sfGFP_scFv_ UBQ10_INSULATOR_UBQ10_dCAS9_1xHA_3xNLS_ 10xGCN422aa_OCS construct described above. ROS1 expression was assayed using qPCR, and the results are presented in FIG. 21. The results presented in FIG. 21 demonstrate that targeting the TET1 catalytic domain (TET1-CD) to the ROS1 locus using the SunTag targeting scheme can efficiently repress ROS1 expression.

Figure 20:
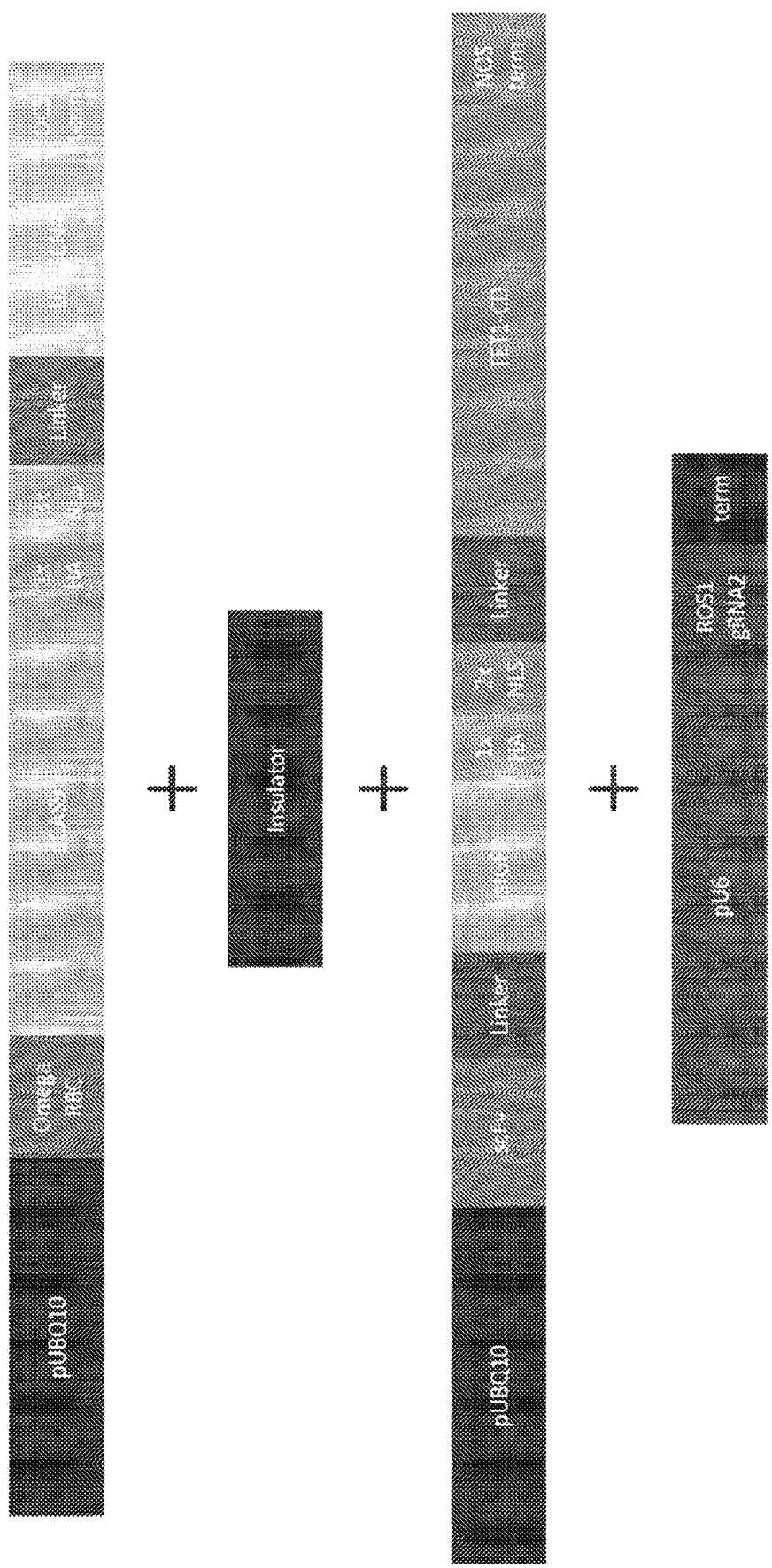
FIG. 20 illustrates a schematic of a SunTag targeting system that was used successfully to demethylate the ROS1 promoter.
Figure 22:
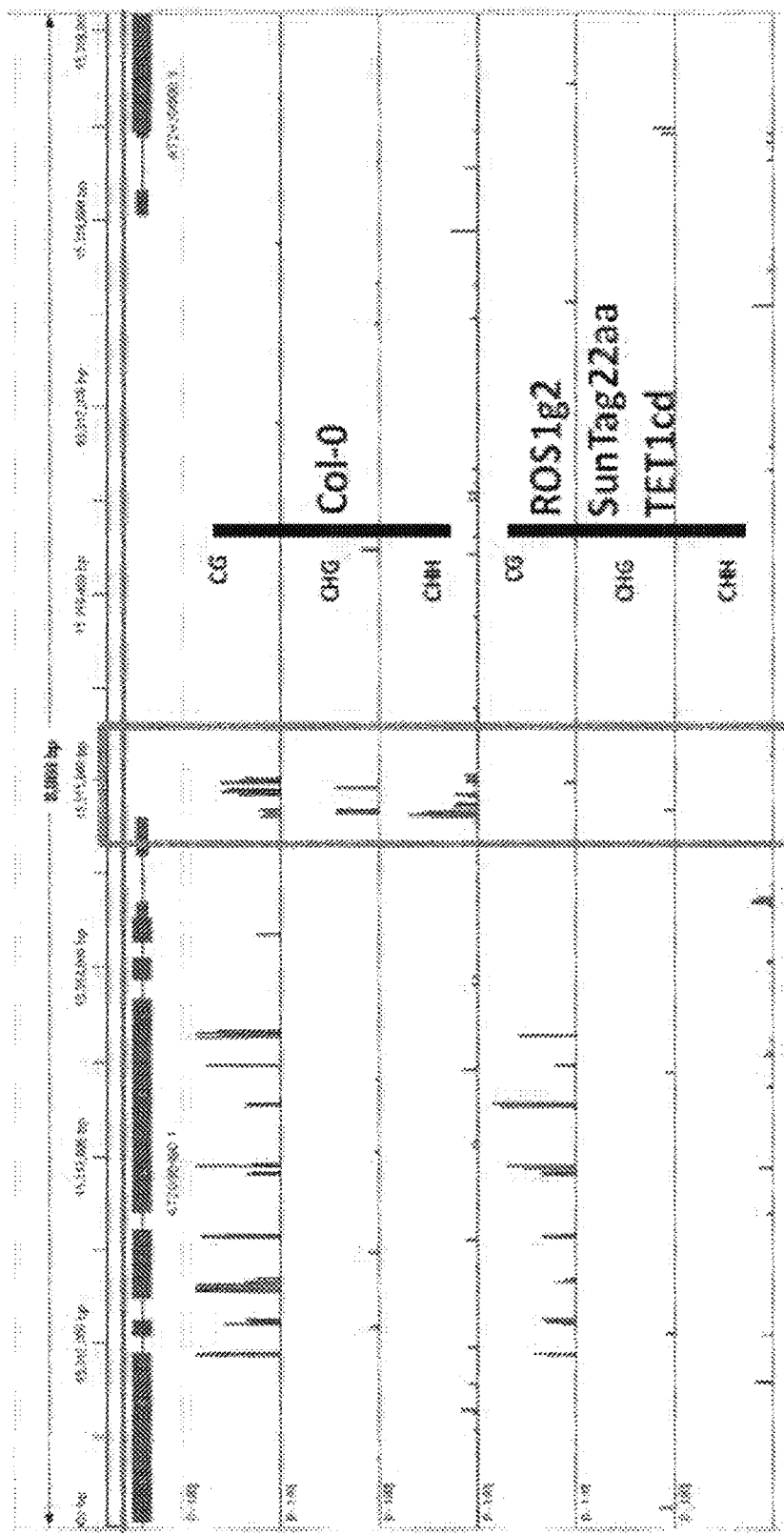
FIG. 22 illustrates Whole Genome Bisulfite Sequencing results. DNA methylation of a wild-type Col-0 plant and a transgenic line that carries the ROS1gRNA2_U6_ NOS_TET1CD_2xNLS_1xHA_sfGFP_scFv_UBQ10_ INSULATOR_UBQ10_dCAS9_1xHA_3xNLS_10xGCN 422aa_OCS (ROS1g2 SunTag22aa TET1cd) construct was analyzed by BS-seq. Methylation levels in different contexts (CG, CHG and CHH, where H is C, T, or A) are shown. The ROS1 promoter region is marked in a red box.
Figure 23:
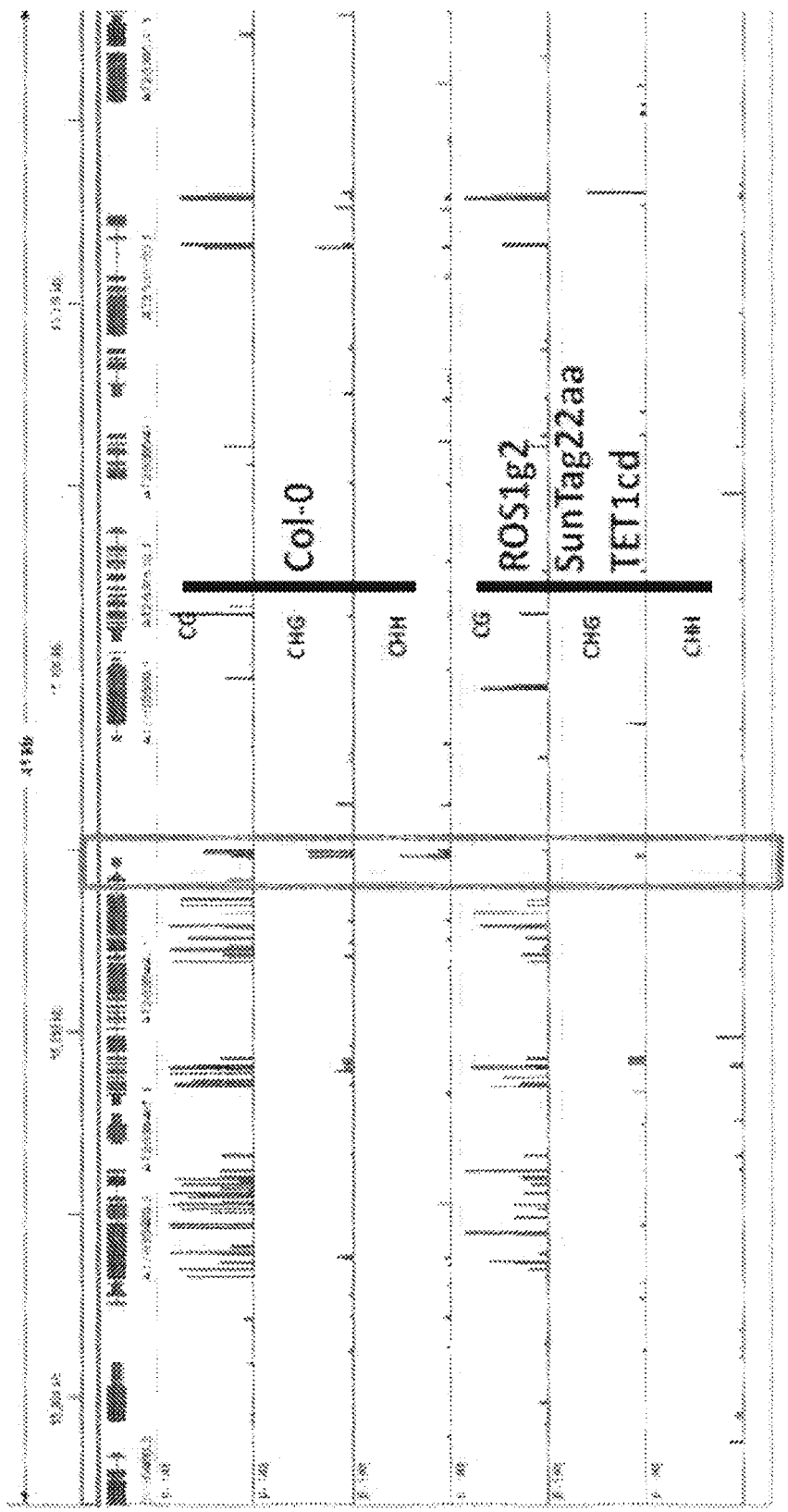
FIG. 23 illustrates a zoomed-out view of the Whole Genome Bisulfite Sequencing results presented in FIG. 22. DNA methylation of a wild-type Col-0 plant and a transgenic line that carries the ROS1gRNA2_U6_NOS_ TET1CD_2xNLS_1xHA_sfGFP_scFv_UBQ10_ INSULATOR_UBQ10_dCAS9_1xHA_3xNLS_10xGCN 422aa_OCS (ROS1g2 SunTag22aa TET1cd) construct was analyzed by BS-seq. Methylation levels in different contexts (CG, CHG and CHH, where H is C, T, or A) are shown. The ROS1 promoter region is marked in a red box.

To test if repression of ROS1 expression in plants containing the ROS1gRNA2_U6_NOS_TET1CD_2xNLS_ 1xHA_sfGFP_scFv_UBQ10_INSULATOR_UBQ10_ dCAS9_1xHA_3xNLS_10xGCN422aa_OCS construct described in FIG. 20 is due to the loss of methylation in the ROS1 promoter, whole-genome BS-Seq experiments were conducted as described above. The results, presented in FIG. 22 and FIG. 23 with differently scaled genome browser views, show a loss of methylation in the ROS1 promoter in backgrounds that contain the ROS1gRNA2_U6_NOS_ TET1CD_2xNLS_1xHA_sfGFP_scFv_UBQ10_INSULA-TOR_UBQ10_dCAS9_1xHA_3xNLS_10xGCN422aa_ OCS construct.

The results presented in this Example demonstrate that the specific targeting of the TET1 catalytic domain to a genomic region of interest can be used to target demethylation and gene repression in plants in a very specific manner. This Example shows that the SunTag system can be used to modify the methylation state of regulatory regions in the *Arabidopsis* genome. It provides the opportunity to explore the regulatory networks controlling the gene expression of specific loci.

Example 8: DNA-Binding Domain-Targeting of Demethylation Factor TET1 (Catalytic Domain) to the CACTA1 Locus in *Arabidopsis*

This Example demonstrates the targeting of the catalytic domain of a TET1 protein to the CACTA1 locus in *Arabidopsis* using synthetic Zinc Finger polypeptides.

Example 1 describes the successful TET1 polypeptide targeting scheme using a synthetic zinc finger designed to target the FWA locus. This Example describes a similar successful targeting scheme using a synthetic zinc finger designed to target the CACTA1 locus.

Materials and Methods

Cloning of pUBQ10::ZF1CACTA1_3xFlag_TET1CD and pUBQ10::ZF2CACTA1_3xFlag_TET1CD

For this purpose, a modified pMDC123 plasmid (Curtis et al, 2003, Plant Phys) was created first, containing 1990 bp of the promoter region of the *Arabidopsis* UBQ10 gene upstream of a cassette containing a HpaI restriction site and a 3xFlag tag creating a pMDC123 pUBQ10_3xFlag vector. Both UBQ10 promoter and 3xFlag are upstream of the gateway cassette (Invitrogen) present in the original pMDC123 plasmid. The TET1cd was delivered into the modified pMDC123 by an LR reaction (Invitrogen), creating an in-frame fusion of the TET1cd cDNA with the upstream 3xFlag cassette resulting in a pMDC123 pUBQ10_3xFlag_TET1cd vector. ZF1CACTA1 or ZF2CACTA1 sequences were plant codon optimized and synthesized by IDT and cloned in the HpaI restriction site in the modified pMDC123_3xFlag_TET1cd plasmid by In-Fusion (Takara) resulting in the creation of pMDC123 pUBQ10_ZF1CACTA1_3xFlag_TET1cd or pMDC123 pUBQ10_ZF2CACTA1_3xFlag_TET1cd vectors.

The nucleotide sequences of pUBQ10:: ZF1CACTA1_3xFlag_TET1CD and pUBQ10:: ZF2CACTA1_3xFlag_TET1CD are presented in SEQ ID NO: 146 and SEQ ID NO: 147, respectively. This expression cassette contains a UBQ10 promoter (SEQ ID NO: 22), the ZF1CACTA1 or ZF2CACTA1 DNA binding domains that targets the CACTA1 promoter (SEQ ID NO: 148 or SEQ ID NO: 149, respectively), a 3X Flag tag (SEQ ID NO: 24), the catalytic domain of human TET1 (SEQ ID NO: 25), and an OCS terminator sequence (SEQ ID NO: 26). pUBQ10:: ZF1CACTA1_3xFlag_TET1CD and pUBQ10:: ZF2CACTA1_3xFlag_TET1CD expression cassettes encode the ZF1CACTA1_3xFlag_TET1CD (SEQ ID NO: 150) or ZF2CACTA1_3xFlag_TET1CD (SEQ ID NO: 151) fusion proteins, respectively. Polypeptides in each fusion protein include ZF1CACTA1 (SEQ ID NO: 152) or ZF2CACTA1 (SEQ ID NO: 153), 3xFlag (SEQ ID NO: 29), and human TET1-CD (SEQ ID NO: 30).

Plant Transformation

The transgenes above were introduced into Col-0 wild-type *Arabidopsis* plants using *Agrobacterium*-mediated transformation. T1 transgenic plants were selected based on their resistance to BASTA.

Bisulfate Sequencing and Data Analysis

BS-Seq libraries were generated as previously reported (Cokus et al., 2008) and all libraries were sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq, up to 2 mismatches were allowed and only uniquely mapped reads were used.

Metaplot of WGBS Data

Metaplots of WGBS data were made using custom Perl and R scripts. Regions of interest were broken into 50 bins while flanking 1 kb regions were each broken into 25 bins. CG, CHG and CHH methylation levels in each bin were then determined. Metaplots were then generated with R.

RNA-Seq

Raw reads in qseq format obtained from the sequencer were first converted to fastq format with a customized perl script. Read quality was controlled with FastQC (http://www.bioinformatics.babraham.ac.uk/projects/fastqc). High quality reads were then aligned to the TAIR10 reference genome using Tophat (Trapnell et al, 2009) (v 2.0.13) by using '-no-coverage-search' option, allowing up to two mismatches and only keeping reads that mapped to one location. Essentially, reads were first mapped to the TAIR10 gene annotation with known splice junctions. When reads did not map to the annotated genes, the reads were mapped to the TAIR10 genome. The number of reads mapping to genes were calculated by HTseq (Anders et al., 2015) (v 0.5.4) with default parameters. Expression levels were determined by RPKM (reads per kilobase of exons per million aligned reads) in R using customized scripts.

Quantitative Real-Time PCR

To assess the level of CACTA1 gene expression, quantitative Real-time PCR (qPCR) was done using the oligos (5'-agtgtttcaatcaaggcgtttc-3') (SEQ ID NO: 185) and (5'-cacccaatggaacaaagtgaac-3') (SEQ ID NO: 186) to amplify a region of the CACTA1 gene. As an internal control, CACTA1 expression values were normalized to the expression of the IPP2 housekeeping gene collected from the same sample using oligos (5'-gtatgagttgcttctccagcaaag-3') (SEQ ID NO: 187) and (5'-gaggatggctgcaacaagtgt-3') (SEQ ID NO: 188).

Results

To test if ZF1CACTA1_TET1-CD or ZF2CACTA1_TET1-CD can reactivate the expression of CACTA1, wild-type Col-0 plants were transformed with either the pUBQ10:: ZF1CACTA1_3xFlag_TET1CD or the pUBQ10::ZF2CACTA1_3xFlag_TET1CD construct described above. Expression of CACTA1 was assayed by RNAseq of individual T1 transgenic plants. The results presented in FIG. 24 demonstrate that the catalytic domain of human TET1 fused to either ZF1CACTA1 or ZF2CACTA1 can efficiently activate the expression of CACTA1.

Figure 24:
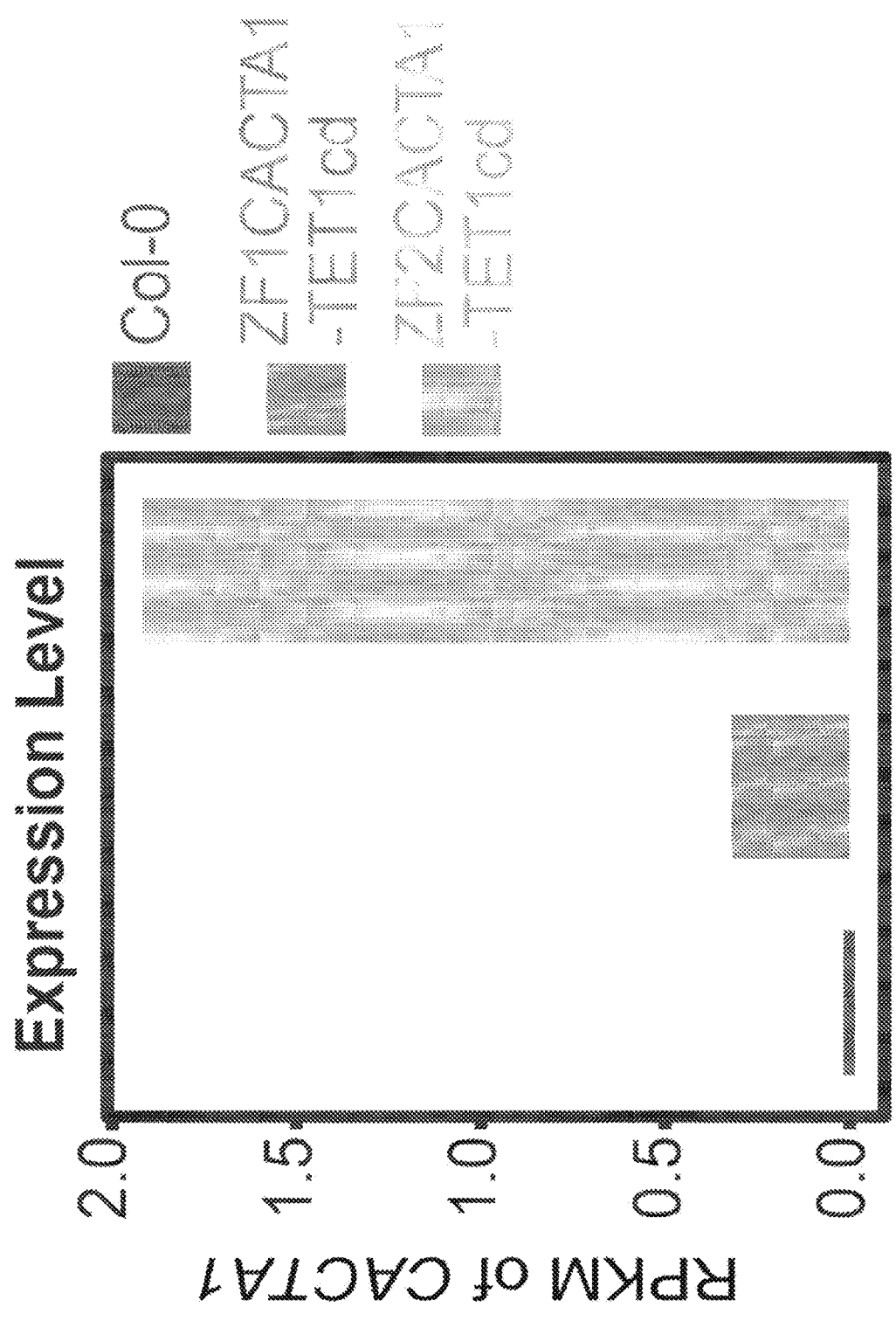
FIG. 24 illustrates RNA-seq analysis of one wild-type Col-0 plant, and T1 transgenic plants carrying either the pUBQ10::ZF1CACTA1_3xFlag_TET1CD or the pUBQ10:: ZF2CACTA1_3xFlag_TET1CD transgene in a bar graph.
Figure 25:
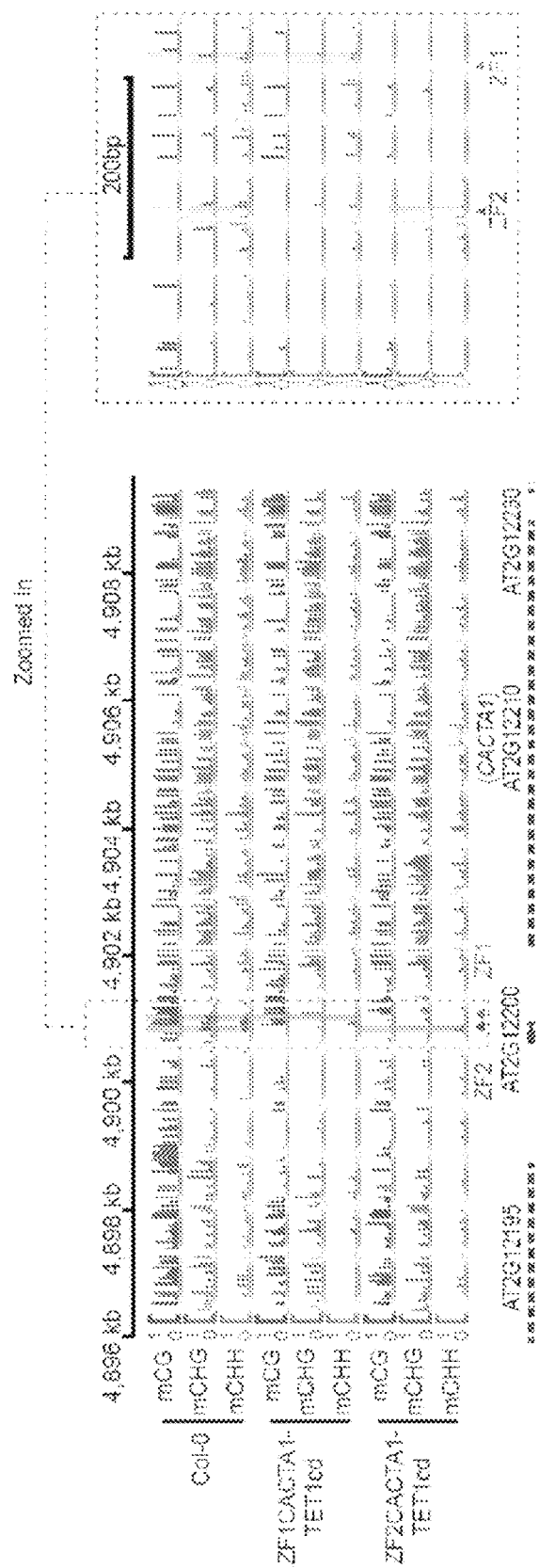
FIG. 25 illustrates Whole Genome Bisulfite Sequencing results. DNA methylation of one wild-type Col-0 plant and two independent transgenic lines that carry either the pUBQ10::ZF1CACTA1_3xFlag_TET1CD or the pUBQ10:: ZF2CACTA1_3xFlag_TET1CD transgene were analyzed by BS-seq. Methylation levels at different contexts (CG, CHG and CHH, where H is C, T, or A) are shown. A red arrow indicates the ZF1CACTA1 binding site and a purple arrow indicates the ZF2CACTA1 binding site in the promoter region of CACTA1. A zoom in of the targeted region is shown (right).
Figure 26:
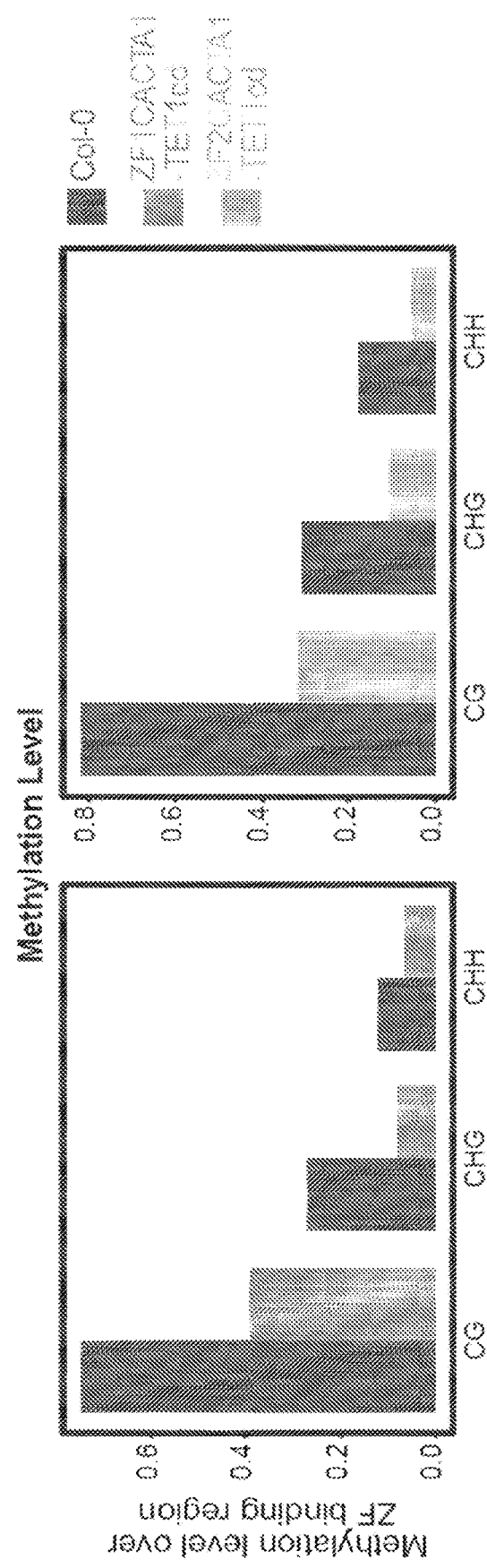
FIG. 26 illustrates the methylation levels in the region comprising 200 bp upstream and downstream of either the ZF1CACTA1 or ZF2CACTA1 binding site in a bar graph for Col-0 and a T1 plant containing either the pUBQ10:: ZF1CACTA1_3xFlag_TET1CD or the pUBQ10:: ZF2CACTA1_3xFlag_TET1CD transgene.

To test if reactivation of CACTA1 expression in plants containing the pUBQ10:: ZF1CACTA1_3xFlag_TET1CD or pUBQ10::ZF2CACTA1_3xFlag_TET1CD transgenes described in FIG. 24 is due to the loss of methylation in the CACTA1 promoter, whole-genome BS-Seq experiments were conducted as described above. The results, presented in FIG. 25 and FIG. 26 for plants containing either the pUBQ10:: ZF1CACTA1_3xFlag_TET1CD transgene or the pUBQ10::ZF2CACTA1_3xFlag_TET1CD transgene, show a loss of methylation in the CACTA1 promoter in both backgrounds.

Figure 27:
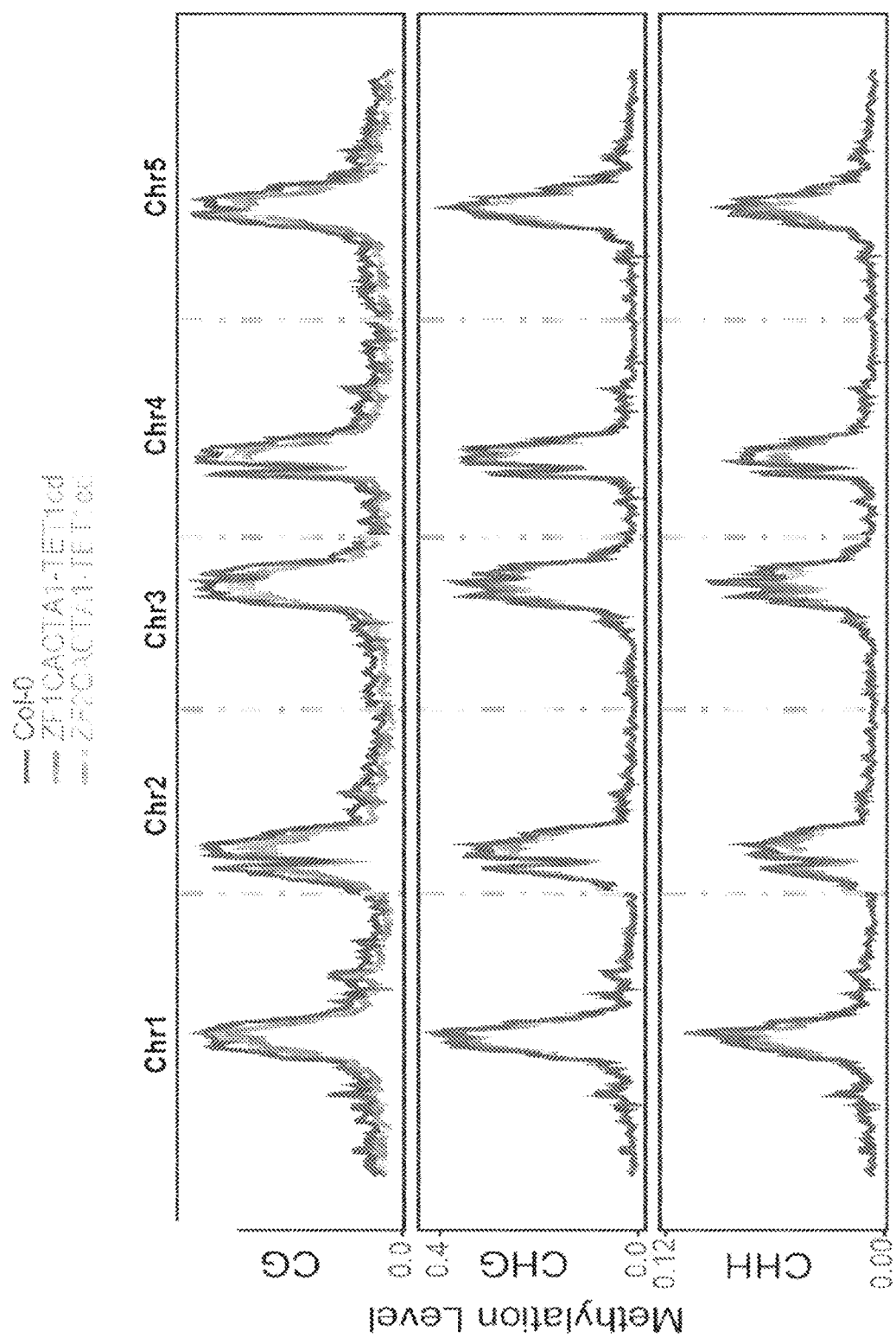
FIG. 27 illustrates the genome-wide CG, CHG and CHH methylation levels in one wild-type Col-0 plant and a T1 plant containing either the pUBQ10:: ZF1CACTA1_3xFlag_TET1CD or the pUBQ10:: ZF2CACTA1_3xFlag_TET1CD transgene. Percent methylation is depicted on the Y-axis.
Figure 28:
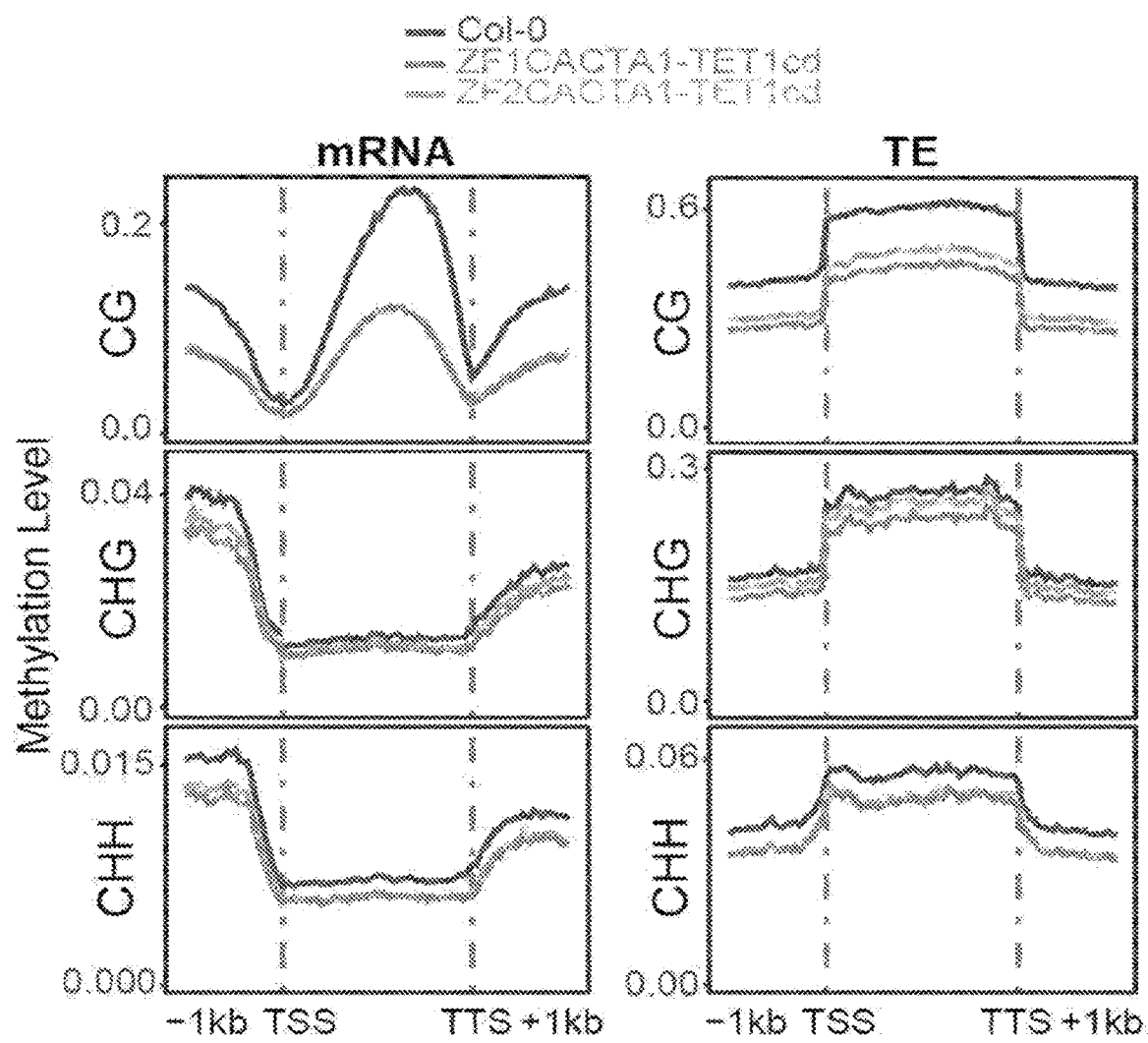
FIG. 28 illustrates a metaplot showing CG, CHG, and CHH methylation levels over all protein coding genes and TEs in one wild-type Col-0 plant and a T1 plant containing either the pUBQ10::ZF1CACTA1_3xFlag_TET1CD or the pUBQ10::ZF2CACTA1_3xFlag_TET1CD transgene.

To test the specificity of the targeted demethylation caused by the expression of the pUBQ10:: ZF1CACTA1_3xFlag_TET1CD or the pUBQ10:: ZF2CACTA1_3xFlag_TET1CD transgene in T1 plants, genome-wide methylation levels and methylation levels over all protein coding genes or TEs was checked and compared with that of a Col-0 control plant. The results, presented in FIG. 27 and FIG. 28, show that genome-wide DNA methylation levels across the entire genome were slightly reduced as compared to the Col-0 control in plants containing either the pUBQ10:: ZF1CACTA1_3xFlag_TET1CD or the pUBQ10:: ZF2CACTA1_3xFlag_TET1CD transgene, indicating a partial non-specific global demethylation. Although this non-specific genome-wide demethylation had minor effects, it suggests that it is important to carefully screen through several transgenic lines to find ones with limited off target activity, while retaining high levels of on target demethylation.

Figure 29:
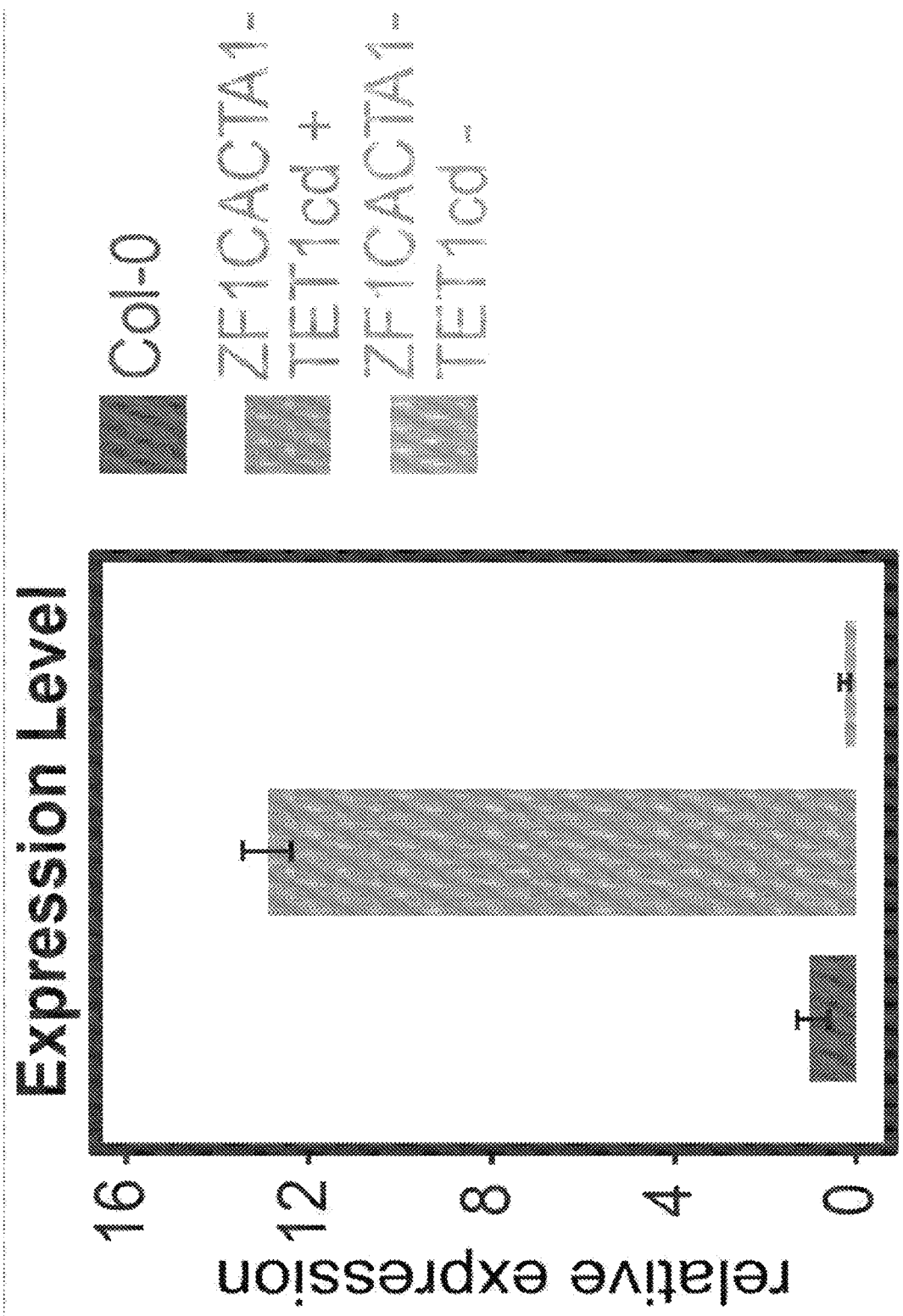
FIG. 29 illustrates quantitative real-time PCR results in a bar graph showing relative expression of CACTA1 over IPP2 in one wild-type Col-0 plant and a T2 plant that has retained the pUBQ10::ZF1CACTA1_3xFlag_TET1CD transgene (+) and a T2 plant that has had the transgene segregated away (−).

To test if the upregulation of CACTA1 gene expression in T2 backgrounds that have either retained the ZF1CACTA1_TET1-CD transgene or had the transgene segregated away is heritable, CACTA1 expression was checked using qPCR as described above. The results presented in FIG. 29 show that in backgrounds that have retained the ZF1CACTA1_TET1-CD transgene, CACTA1 gene expression continues to be unregulated, while in backgrounds that have lost the transgene, expression has been silenced to wild type levels.

Figure 30:
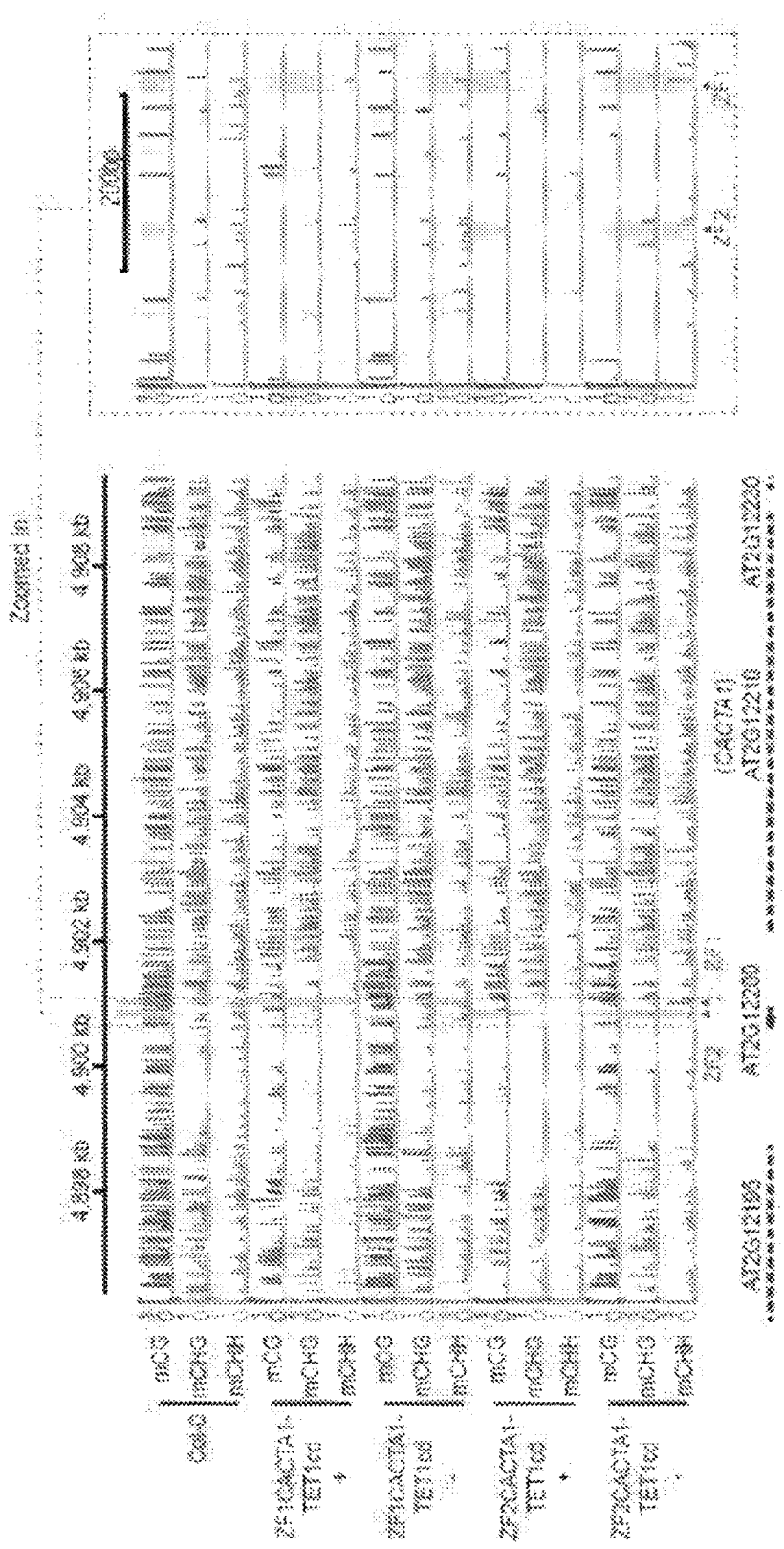
FIG. 30 illustrates Whole Genome Bisulfite Sequencing results. DNA methylation of one wild-type Col-0 plant and T2 plants that have either retained the pUBQ10:: ZF1CACTA1_3xFlag_TET1CD or the pUBQ10:: ZF2CACTA1_3xFlag_TET1CD transgene (+), or have had the transgene segregated away (−) were analyzed by BS-seq. Methylation levels at different contexts (CG, CHG and CHH, where H is C, T, or A) are shown. A red arrow indicates the ZF1 binding site and a blue arrow indicates the ZF2 binding site in the promoter region of CACTA1. A zoom in of the targeted region is shown (right).
Figure 31:
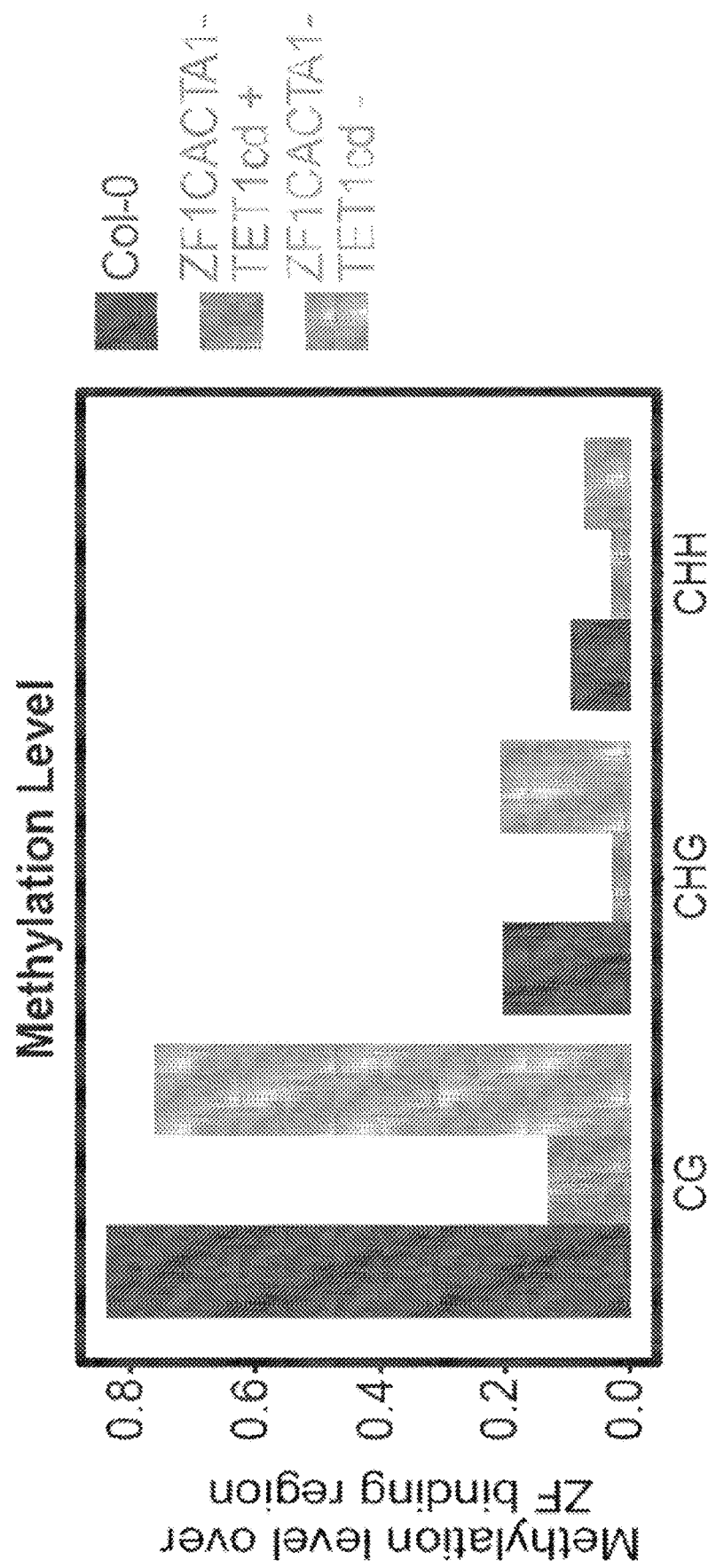
FIG. 31 illustrates the methylation levels in the region comprising 200 bp upstream and downstream of the ZF1CACTA1 binding site in a bar graph for one wild-type Col-0 plant and a T2 plant that has retained the pUBQ10:: ZF1CACTA1_3xFlag_TET1CD transgene (+) and a T2 plant that has had the transgene segregated away (−).

To test if the loss of methylation in the CACTA1 promoter in plants containing the pUBQ10:: ZF1CACTA1_3xFlag_TET1CD or the pUBQ10:: ZF2CACTA1_3xFlag_TET1CD transgene is heritable, whole-genome BS-Seq experiments were conducted as described above on T2 plants that have either retained the pUBQ10::ZF1CACTA1_3xFlag_TET1CD or the pUBQ10:: ZF2CACTA1_3xFlag_TET1CD transgene, or had the transgene segregated away. The results, presented in FIG. 30 and FIG. 31 for plants containing either the pUBQ10:: ZF1CACTA1_3xFlag_TET1CD transgene or the pUBQ10:: ZF2CACTA1_3xFlag_TET1CD transgene, show a loss of methylation in the CACTA1 promoter in backgrounds that have retained the transgene, while backgrounds that have lost the transgene show a re-establishment of methylation levels similar to Col-0.

The re-establishment of methylation and silencing of CACTA1 after the removal of the TET1CD transgene was is in contrast to FWA, where methylation loss was stable in the absence of the transgene, and without wishing to be bound by theory, is likely a consequence of the incomplete removal of DNA methylation in the CACTA1 region that is then able to attract the methylation machinery through self-reinforcing mechanisms. The incomplete demethylation of CACTA1 likely leaves enough residual methylation to attract the RdDM machinery, probably via recruitment of Pol V by the methyl DNA binding proteins SUVH2 and SUVH9 (Johnson L M, et al. (2014) SRA- and SET-domain-containing proteins link RNA polymerase V occupancy to DNA methylation. Nature 507(7490):124-8.). In addition, the MET1 CG methyltransferase would likely perpetuate and potentially amplify any remaining methylated CG sites. In this scenario, heritable demethylation might be more efficiently achieved by targeting the TET1 cd to multiple adjacent locations to achieve a more complete demethylation. Alternatively, and without wishing to be bound by theory, CACTA1 remethylation may occur because other methylated regions in the genome with sequences homologous to CACTA1 may be able to efficiently target remethylation in trans via siRNAs. In this scenario it may be useful to simultaneously target all homologous sequences for demethylation to reduce the prevalence of remethylation by homologous sequences.

Figure 32:
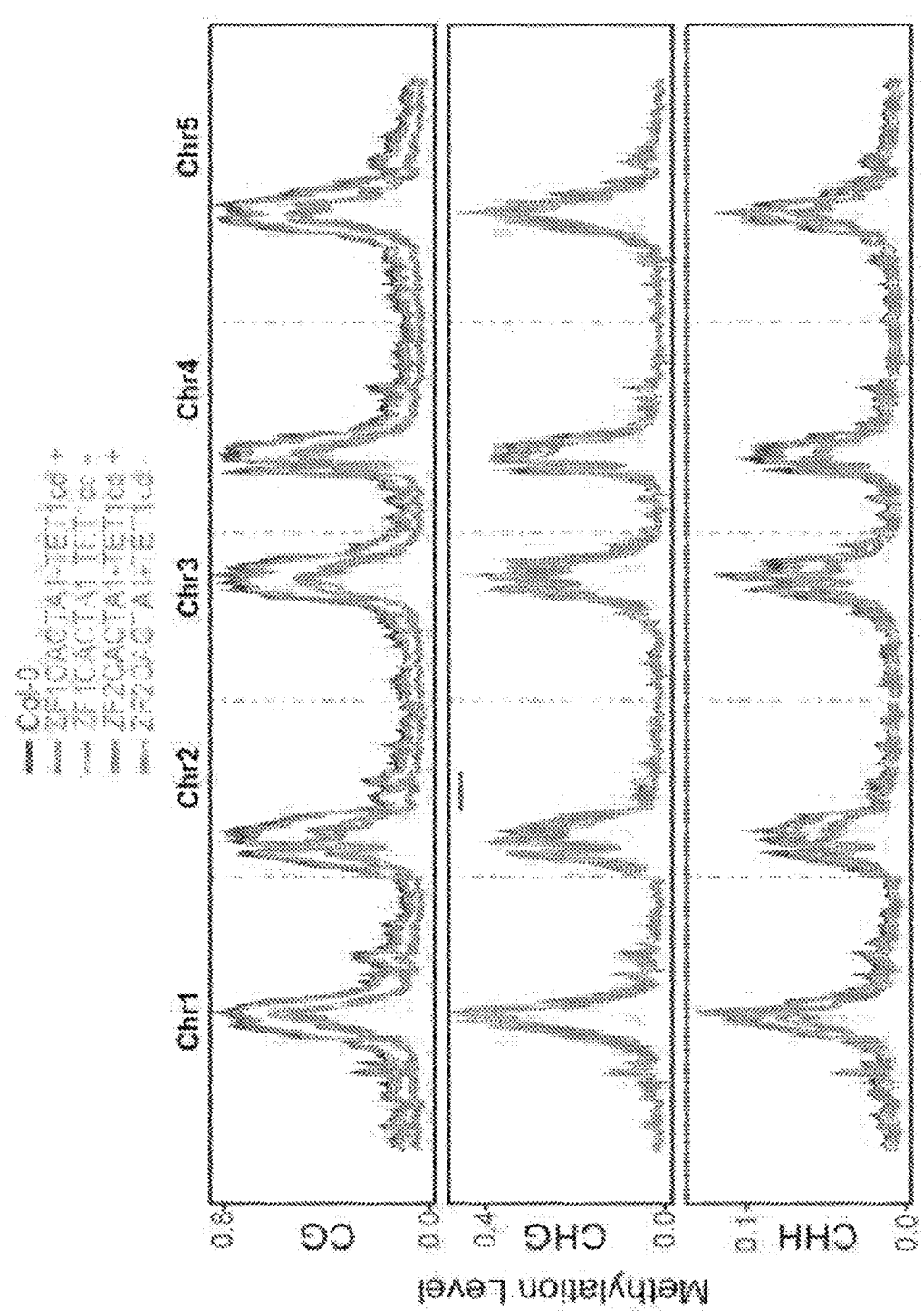
FIG. 32 illustrates the genome-wide CG, CHG and CHH methylation levels in one wild-type Col-0 plant and T2 plants that have either retained the pUBQ10:: ZF1CACTA1_3xFlag_TET1CD or the pUBQ10:: ZF2CACTA1_3xFlag_TET1CD transgene (+), or have had the transgene segregated away (−). Percent methylation is depicted on the Y-axis.
Figure 33:
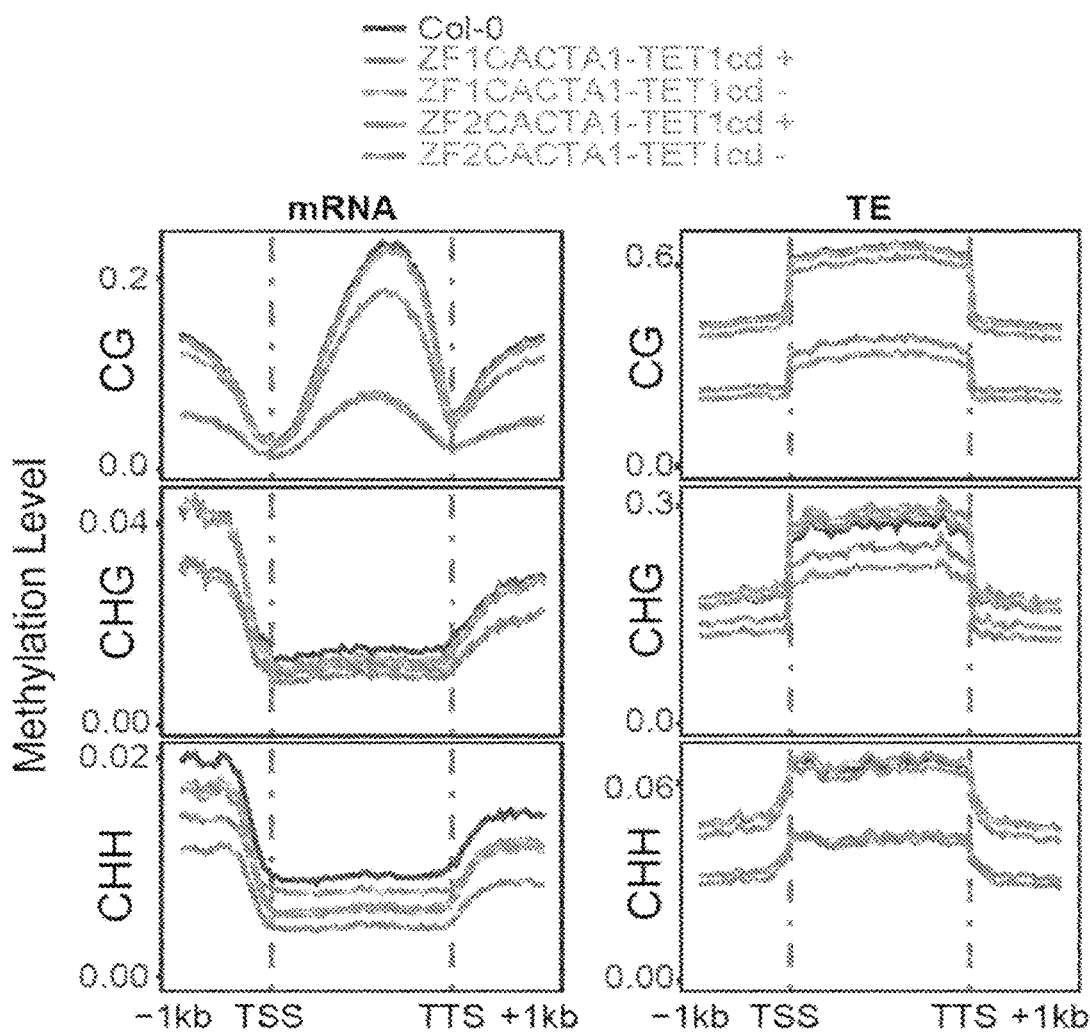
FIG. 33 illustrates a metaplot showing CG, CHG, and CHH methylation levels over all protein coding genes and TEs in one wild-type Col-0 plant and T2 plants that have either retained the pUBQ10:: ZF1CACTA1_3xFlag_TET1CD or the pUBQ10:: ZF2CACTA1_3xFlag_TET1CD transgene (+), or have had the transgene segregated away (−).

To test the specificity of the targeted demethylation caused by the expression of the pUBQ10:: ZF1CACTA1_3xFlag_TET1CD or the pUBQ10:: ZF2CACTA1_3xFlag_TET1CD system, genome-wide methylation levels and methylation levels over all protein coding genes or TEs of T2 plants that contained the transgene (=) or had it segregated away (−) were checked and compared with that of a Col-0 control plant. The results, presented in FIG. 32 and FIG. 33, show that genome-wide DNA methylation levels across the entire genome were reduced as compared to the Col-0 control in plants that had retained either the pUBQ10:: ZF1CACTA1_3xFlag_TET1CD or the pUBQ10:: ZF2CACTA1_3xFlag_TET1CD transgene. However, in T2 plants that have had the transgene segregated away, genome-wide DNA methylation levels returned to levels similar to that seen in the Col-0 control background.

Example 9: DNA-Binding Domain-Targeting of Demethylation Factor TET1 (Catalytic Domain) to the ROS1 Locus in *Arabidopsis*

This Example demonstrates the targeting of the catalytic domain of a TET1 protein to the ROS1 locus in *Arabidopsis* using synthetic Zinc Finger polypeptides.

Examples 1 and 8 describe the successful TET1 polypeptide targeting scheme using a synthetic zinc finger designed to target the FWA or CACTA1 loci, respectively. This Example describes a similar successful targeting scheme using a synthetic zinc finger designed to target the ROS1 locus.

Materials and Methods

Cloning of pUBQ10::ZF1ROS1_3xFlag_TET1CD

For this purpose, a modified pMDC123 plasmid (Curtis et al, 2003, Plant Phys) was created first, containing 1990 bp of the promoter region of the *Arabidopsis* UBQ10 gene upstream of a cassette containing a HpaI restriction site and a 3xFlag tag creating a pMDC123 pUBQ10_3xFlag vector. Both UBQ10 promoter and 3xFlag are upstream of the gateway cassette (Invitrogen) present in the original pMDC123 plasmid. The TET1cd was delivered into the modified pMDC123 by an LR reaction (Invitrogen), creating an in-frame fusion of the TET1cd cDNA with the upstream 3xFlag cassette resulting in a pMDC123 pUBQ10_3xFlag_TET1cd vector. The ZF1ROS1 sequences was plant codon optimized and synthesized by IDT and cloned in the HpaI restriction site in the modified pMDC123_3xFlag_TET1cd plasmid by In-Fusion (Takara) creating the pMDC123 pUBQ10_ZF1ROS1_3xFlag_TET1cd vector.

The nucleotide sequence of pUBQ10::ZF1ROS1_3xFlag_TET1CD is presented in SEQ ID NO: 154. This expression cassette contains a UBQ10 promoter (SEQ ID NO: 22), the ZF1ROS1 DNA binding domain that targets the ROS1 promoter (SEQ ID NO: 155), a 3X Flag tag (SEQ ID NO: 24), the catalytic domain of human TET1 (SEQ ID NO: 25), and an OCS terminator sequence (SEQ ID NO: 26). pUBQ10::ZF1ROS1_3xFlag_TET1CD expression cassette encodes the ZF1ROS1_3xFlag_TET1CD (SEQ ID NO: 156) fusion protein. Polypeptides in this fusion protein include ZF1ROS1 (SEQ ID NO: 157), 3xFlag (SEQ ID NO: 29), and human TET1-CD (SEQ ID NO: 30).

Plant Transformation

The construct above was introduced into Col-0 wild-type *Arabidopsis* plants using *Agrobacterium*-mediated transformation. T1 transgenic plants were selected based on their resistance to BASTA.

Bisulfite Sequencing and Data Analysis

BS-Seq libraries were generated as previously reported (Cokus et al., 2008) and all libraries were sequenced using the HiSeq 2000 platform following manufacturer instructions (Illumina) at a length of 50 bp. Bisulfite-Seq (BS-Seq) reads were aligned to the TAIR10 version of the *Arabidopsis thaliana* reference genome using BS-seeker. For BS-Seq, up to 2 mismatches were allowed and only uniquely mapped reads were used.

Metaplot of WGBS Data

Metaplots of WGBS data were made using custom Perl and R scripts. Regions of interest were broken into 50 bins while flanking 1 kb regions were each broken into 25 bins. CG, CHG and CHH methylation levels in each bin were then determined. Metaplots were then generated with R.

RNA-Seq

Raw reads in qseq format obtained from the sequencer were first converted to fastq format with a customized perl script. Read quality was controlled with FastQC (http://www.bioinformatics.babraham.ac.uk/projects/fastqc). High quality reads were then aligned to the TAIR10 reference genome using Tophat (Trapnell et al, 2009) (v 2.0.13) by using '-no-coverage-search' option, allowing up to two mismatches and only keeping reads that mapped to one location. Essentially, reads were first mapped to the TAIR10 gene annotation with known splice junctions. When reads did not map to the annotated genes, the reads were mapped to the TAIR10 genome. The number of reads mapping to genes were calculated by HTseq (Anders et al., 2015) (v 0.5.4) with default parameters. Expression levels were determined by RPKM (reads per kilobase of exons per million aligned reads) in R using customized scripts.

Results

Figure 34:
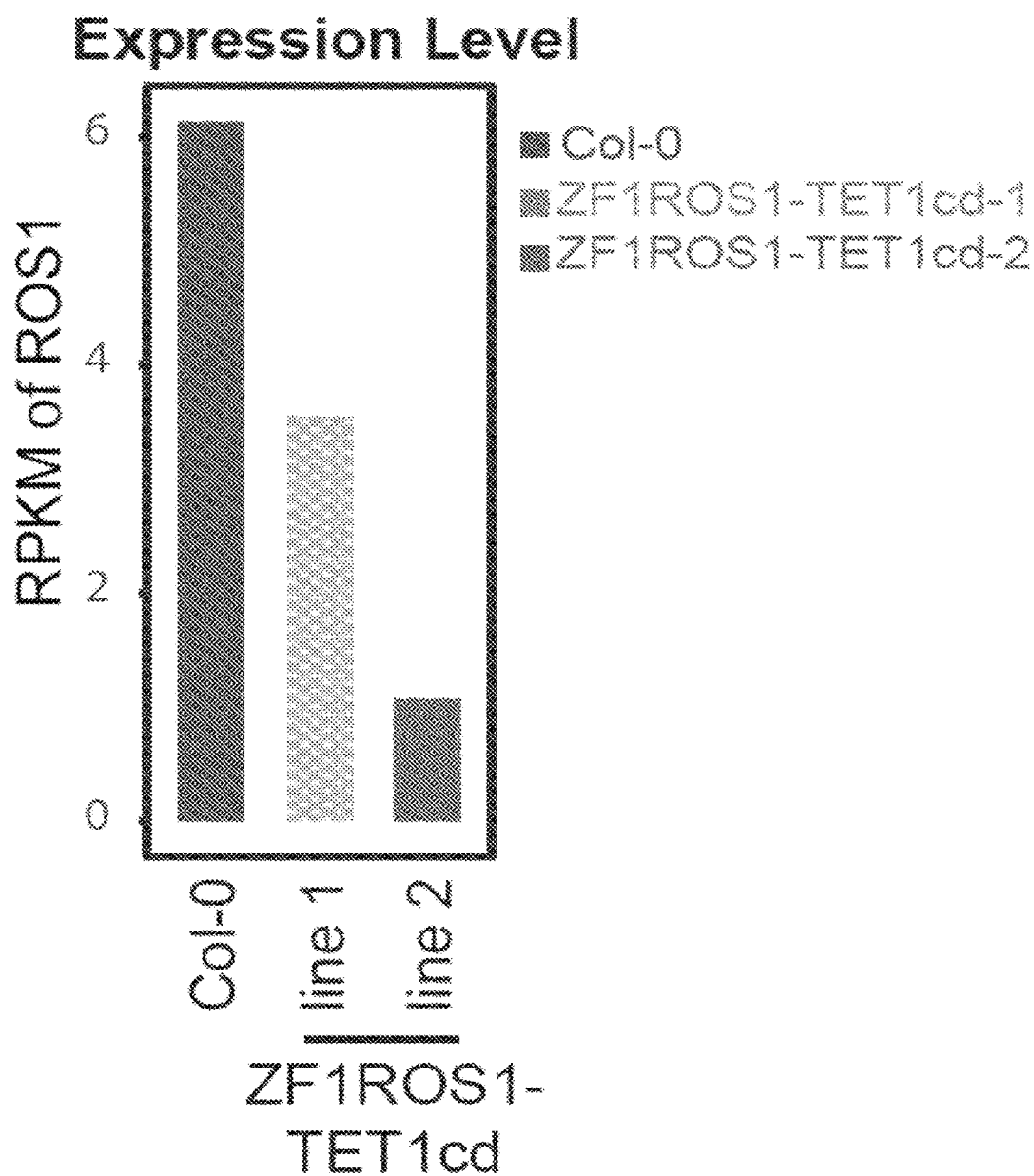
FIG. 34 illustrates RNA-seq analysis of one wild-type Col-0 plant and two independent T1 transgenic plants carrying the pUBQ10::ZF1ROS1_3xFlag_TET1cd transgene in a bar graph. RPKM values are indicated.

ROS1 is an example of a gene whose expression depends on DNA methylation. Methylation mutants with lower DNA methylation in the ROS1 promoter show reduced ROS1 expression (Lei M, et al. (2015) Regulatory link between DNA methylation and active demethylation in *Arabidopsis*. *Proc Natl Acad Sci* 112(11):3553-3557; Williams B P, Pignatta D, Henikoff S, Gehring M (2015) Methylation-Sensitive Expression of a DNA Demethylase Gene Serves As an Epigenetic Rheostat. *PLoS Genet* 11(3):1-18.). To test if ZF1ROS1 TET1-CD can repress the expression of ROS1, wild-type Col-0 plants were transformed with the pUBQ10::ZF1ROS1_3xFlag_TET1CD construct described above. Expression of ROS1 was assayed in one wild-type Col-0 plant and two individual T1 transgenic plants by RNA-seq (FIG. 34). The results presented in FIG. 34 demonstrate that the catalytic domain of human TET1 fused to a zinc finger that targets the ROS1 locus can efficiently repress the expression of ROS1.

Figure 35:
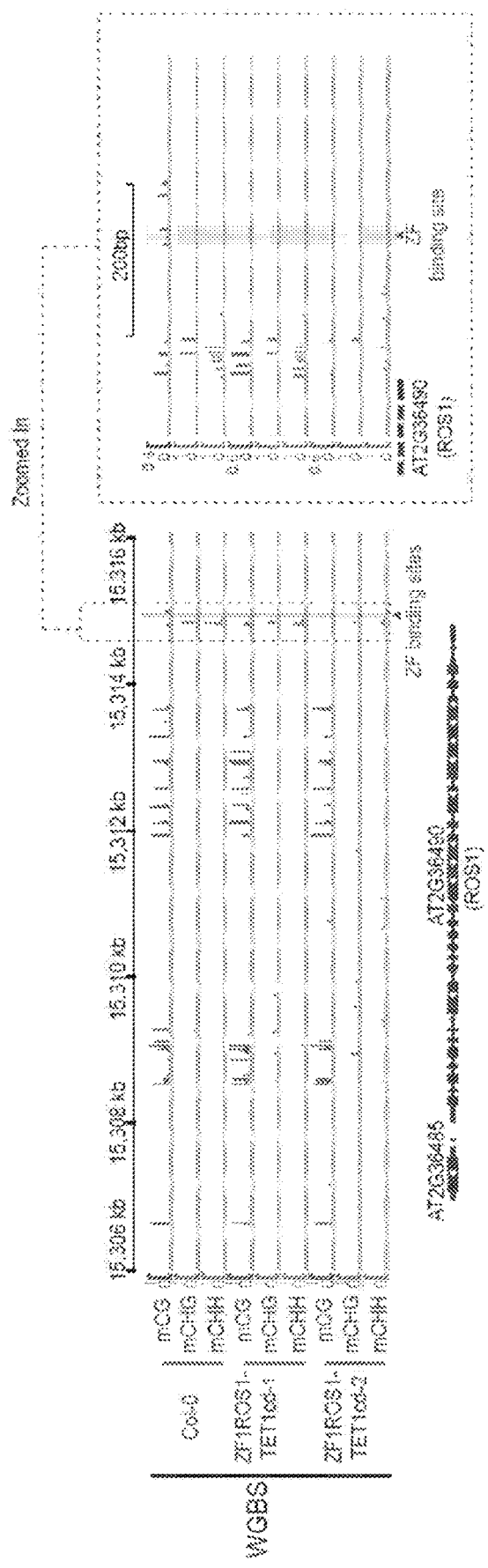
FIG. 35 illustrates Whole Genome Bisulfite Sequencing results. DNA methylation of one wild-type Col-0 plant and two independent T1 transgenic plants carrying the pUBQ10:: ZF1ROS1_3xFlag_TET1cd transgene were analyzed by BS-seq. Methylation levels at different contexts (CG, CHG and CHH, where H is C, T, or A) are shown. A blue arrow indicates the ZF1 binding site in the promoter region of ROS1. A zoom in of the targeted region is shown (right).
Figure 36:
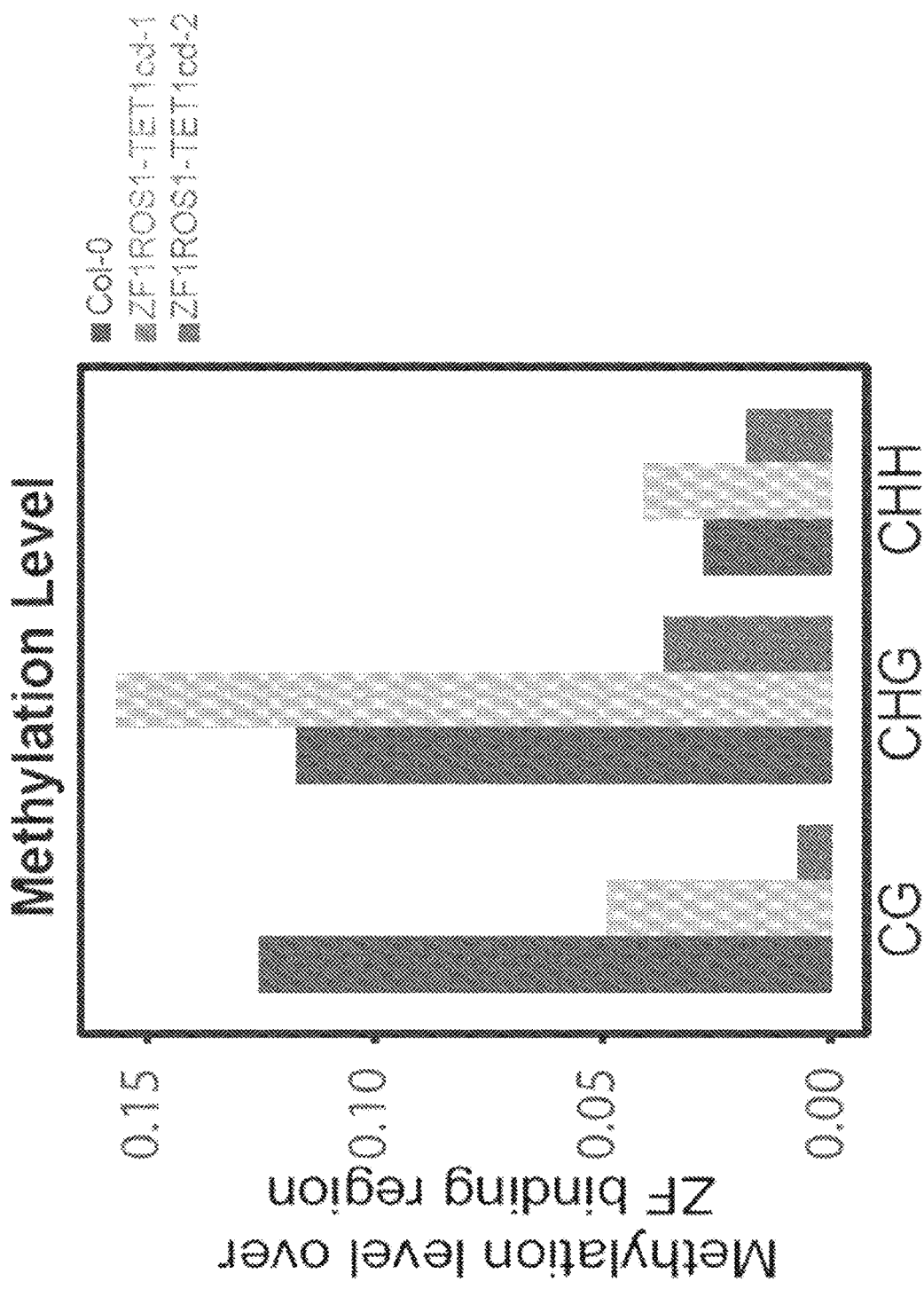
FIG. 36 illustrates the methylation levels in the region comprising 200 bp upstream and downstream of the ZF1ROS1 binding site in a bar graph of one wild-type Col-0 plant and two independent T1 transgenic plants carrying the pUBQ10::ZF1ROS1_3xFlag_TET1cd transgene.

To test if the repression of ROS1 expression in plants containing the pUBQ10:: ZF1ROS1_3xFlag_TET1CD transgene described in FIG. 34 is due to the loss of methylation in the ROS1 promoter, whole-genome BS-Seq experiments were conducted as described above. The results for plants containing the pUBQ10::ZF1ROS1_3xFlag_TET1CD construct, presented in FIG. 35 and FIG. 36, show a loss of methylation in the ROS1 promoter in backgrounds that contain the pUBQ10::ZF1ROS1_3xFlag_TET1CD construct. Line 2, which showed the most demethylation (FIG. 35 and FIG. 36), also showed the most RNA downregulation (FIG. 34). This result is consistent with the aforementioned two studies which suggested that ROS1 expression is controlled by its methylation status.

Figure 37:
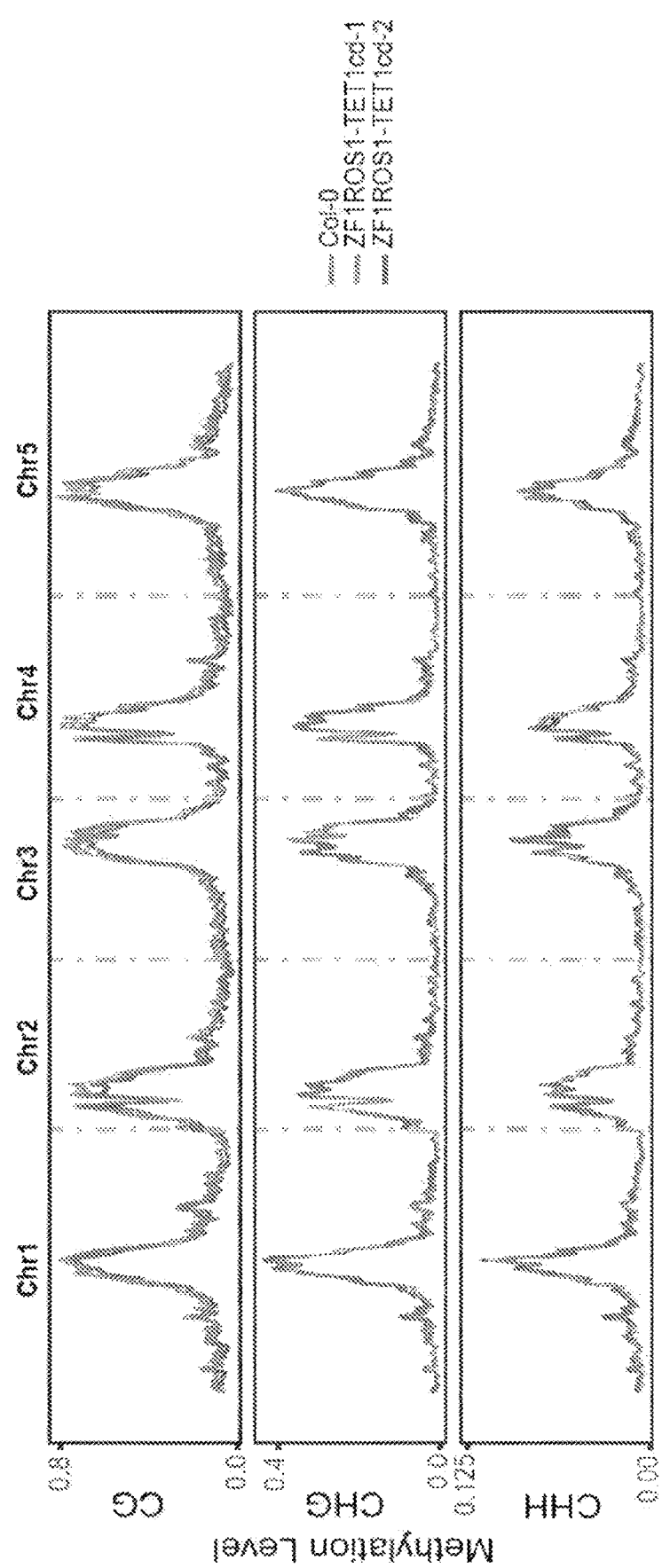
FIG. 37 illustrates the genome-wide CG, CHG and CHH methylation levels in Col-0 and two independent T1 transgenic plants carrying the pUBQ10:: ZF1ROS1_3xFlag_TET1cd transgene. Percent methylation is depicted on the Y-axis.
Figure 38:
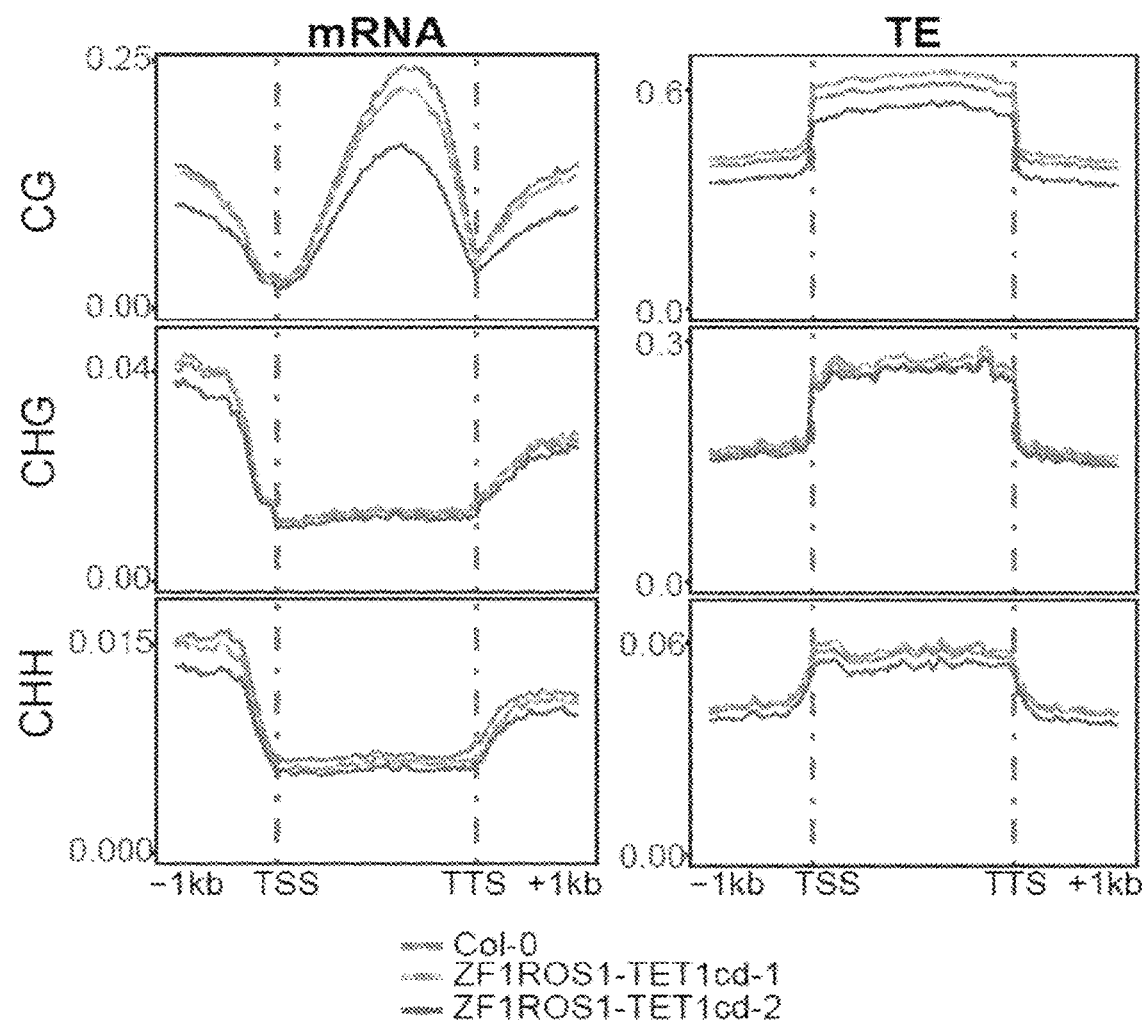
FIG. 38 illustrates a metaplot showing CG, CHG, and CHH methylation levels over all protein coding genes and TEs of one wild-type Col-0 plant and two independent T1 transgenic plants carrying the pUBQ10::ZF1ROS1_3xFlag_TET1cd transgene.

To test the specificity of the targeted demethylation caused by the expression of the pUBQ10::ZF1ROS1_3xFlag_TET1CD transgene in two independent T1 plants, genome-wide methylation levels and methylation levels over all protein coding genes or TEs was analyzed and compared with that of a Col-0 control plant. The results, presented in FIG. 37 and FIG. 38, show that genome-wide DNA methylation levels of the ZF1ROS1-TET1cd-2 T1 plant across the entire genome were very slightly reduced as compared to the Col-0 control, indicating a partial non-specific global demethylation, while the methylation levels of the ZF1ROS1-TET1cd-1 line were very similar to wild type. Similarly to Example 8, this underscores the need to choose lines that show minimal genome-wide effects, while showing high on target activity.

Example 10: Heritability and Specificity of the SunTag-Based Targeting of TET1 to the FWA Locus In the present Example, Applicant provides additional evidence that the SunTag targeting scheme described in Example 5 is able target a TET1 polypeptide to the FWA locus in *Arabidopsis* using the CRISPR-CAS9 system. The heritability and specificity of this SunTag targeting scheme is also evaluated.

Materials and Methods

Constructs

Construction of the gRNA4_U6_NOS_TET1CD_ 2xNLS_1xHA_sfGFP_scFv_UBQ10_INSULATOR_ UBQ10_dCAS9_1xHA_3xNLS_10xGCN422aa_OCS was described in Example 5.

Construction of the gRNA4_U6_NOS_TET1CD_ 2xNLS_1xHA_sfGFP_scFv_UBQ10_INSULATOR_ UBQ10_dCAS9_1xHA_3xNLS_10xGCN414aa_OCS was described in Example 5.

Plant Transformation and Flowering Time Measurement

The constructs described above were transformed into Col-0 wild-type plants using *Agrobacterium*-mediated genetic transformation (after the construct was transformed into *Agrobacterium*). Among a segregating population of T2 plants carrying either the gRNA4_U6_NOS_TET1CD_ 2xNLS_1xHA_sfGFP_scFv_UBQ10_INSULATOR_ UBQ10_dCAS9_1xHA_3xNLS_10xGCN422aa_OCS or the gRNA4_U6_NOS_TET1CD_2xNLS_1xHA_sfGFP_ scFv_UBQ10_INSULATOR_UBQ10_dCAS9_1xHA_ 3xNLS_10xGCN414aa_OCS transgene, flowering time was measured and compared to early-flowering wild-type Col-0 and late-flowering fwa-4 plants. Flowering time was measured by counting the total number of leaves (rosette and cauline) of each individual plant.

Bisulfate Sequencing and Data Analysis

Whole genome bisulfite sequencing (BS-Seq) libraries were generated as previously reported (Cokus et al., 2008) and all libraries were sequenced using the HiSeq 4000 platform following manufacturer instructions (Illumina) at a length of 50 bp. BS-Seq reads were aligned to the TAIR10 version of the *Arabidopsis thaliana* reference genome using BS-map-2.74. For BS-Seq, up to 2 mismatches were allowed and only uniquely mapped reads were used.

Metaplot of WGBS Data

Metaplots of WGBS data were made using custom Perl and R scripts. Regions of interest were broken into 50 bins while flanking 1 kb regions were each broken into 25 bins. CG, CHG and CHH methylation levels in each bin were then determined. Metaplots were then generated with R.

RNA-Seq

Raw reads in qseq format obtained from the sequencer were first converted to fastq format with a customized perl script. Read quality was controlled with FastQC (http://www.bioinformatics.babraham.ac.uk/projects/fastqc). High quality reads were then aligned to the TAIR10 reference genome using Tophat (Trapnell et al, 2009) (v 2.0.13) by using '-no-coverage-search' option, allowing up to two mismatches and only keeping reads that mapped to one location. Essentially, reads were first mapped to the TAIR10 gene annotation with known splice junctions. When reads did not map to the annotated genes, the reads were mapped to the TAIR10 genome. The number of reads mapping to genes were calculated by HTseq (Anders et al., 2015) (v 0.5.4) with default parameters. Expression levels were determined by RPKM (reads per kilobase of exons per million aligned reads) in R using customized scripts.

Results

Figure 39:
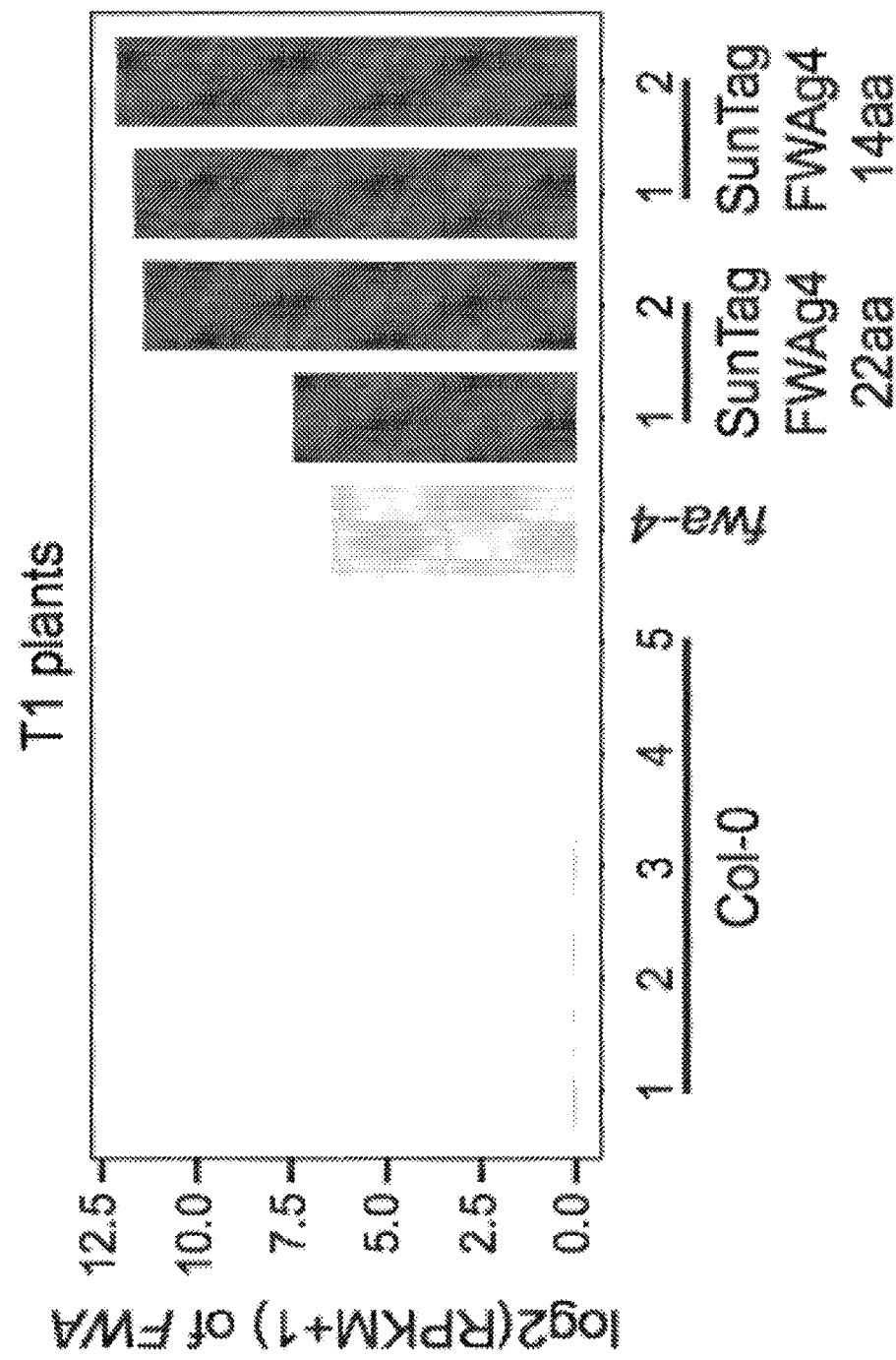
FIG. 39 illustrates RNA-seq analysis of five Col-0 wild-type plants, fwa-4, two independent T1 lines for the gRNA4_U6_NOS_TET1CD_2xNLS_1xHA_sfGFP_scFv_UBQ10_INSULATOR_UBQ10_dCAS9_1xHA_3xNLS_10xGCN422aa_OCS (SunTag FWAg4-22aa-TET1) transgene, and two independent T1 lines for the gRNA4_U6_NOS_TET1CD_2xNLS_1xHA_sfGFP_scFv_UBQ10_INSULATOR_UBQ10dCAS9_1xHA_3xNLS_10xGCN414aa_OCS (SunTag FWAg4-14aa-TET1) trans gene displayed in a bar graph.

To test if the late flowering phenotype of a late flowering plant containing the gRNA4_U6_NOS_TET1CD_ 2xNLS_1xHA_sfGFP_scFv_UBQ10_INSULATOR_ UBQ10_dCAS9_1xHA_3xNLS_10xGCN422aa_OCS construct or the gRNA4_U6_NOS_TET1CD_ 2xNLS_1xHA_sfGFP_scFv_UBQ10_INSULATOR_ UBQ10_dCAS9_1xHA_3xNLS_10xGCN414aa_OCS construct originally described in Table 5A was due to the activation of FWA expression, RNA-seq was performed as described above for the T1 lines containing the gRNA4_U6_NOS_TET1CD_2xNLS_1xHA_sfGFP_scFv_ UBQ10_INSULATOR_UBQ10_dCAS9_1xHA_3xNLS_ 10xGCN422aa_OCS transgene or the gRNA4_U6_ NOS_TET1CD_2xNLS_1xHA_sfGFP_scFv_UBQ10_ INSULATOR_UBQ10_dCAS9_1xHA_3xNLS_10xGCN 414aa_OCS transgene. The results presented in FIG. 39 show that FWA expression was upregulated in the transgenic lines tested as compared to expression in Col-0 wild type plants, similarly to what was seen in the late flowering fwa-4 epiallele plant.

Figure 40:
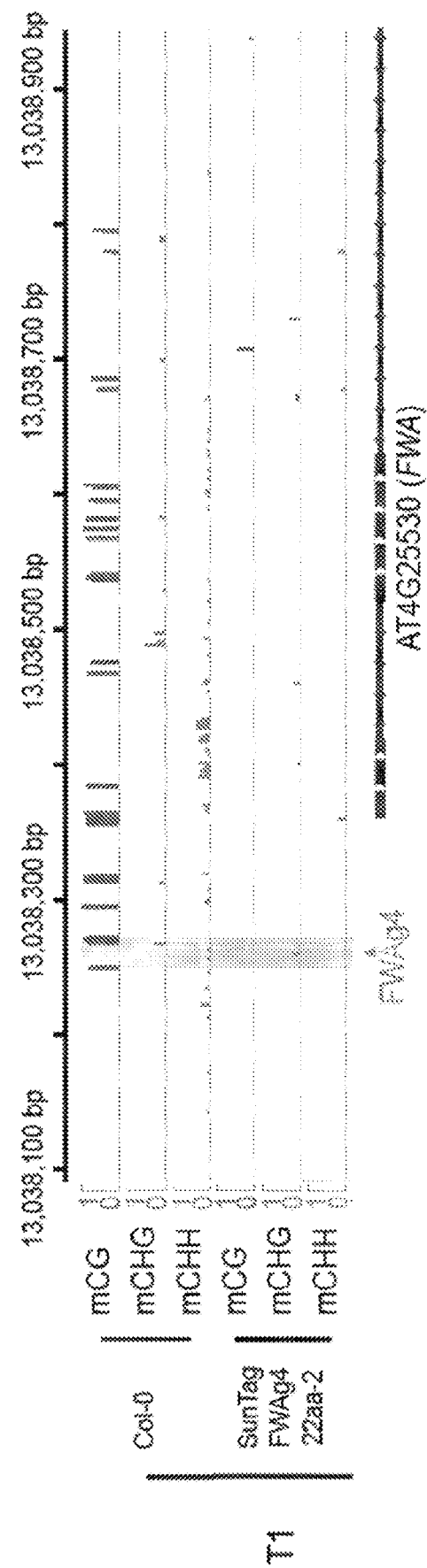
FIG. 40 illustrates Whole Genome Bisulfite Sequencing results. DNA methylation of one wild-type Col-0 plant and a late flowering transgenic line that carries the gRNA4_U6_NOS_TET1CD_2xNLS_1xHA_sfGFP_scFv_UBQ10_INSULATOR_UBQ10dCAS9_1xHA_3xNLS_10xGCN422aa_OCS (SunTagFWAg4-22aa) transgene was analyzed by BS-seq. Methylation levels of different contexts (CG, CHG and CHH, where H is C, T, or A) are shown. A gray arrow indicates the gRNA4 binding site in the promoter region of FWA.
Figure 41:
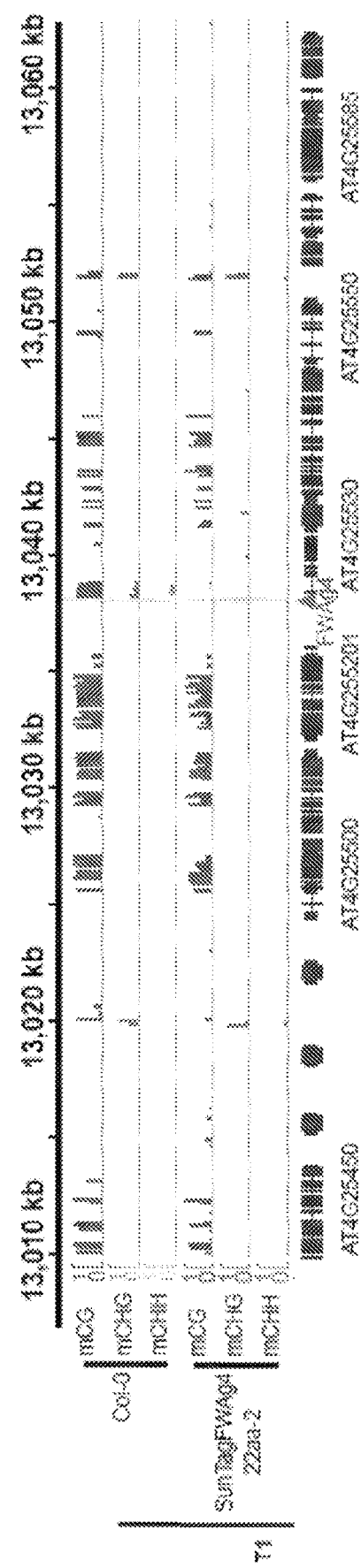
FIG. 41 illustrates a zoomed-out view of the Whole Genome Bisulfite Sequencing results presented in FIG. 40. DNA methylation of one wild-type Col-0 plant and a late flowering transgenic line that carries the gRNA4_U6_NOS_TET1CD_2xNLS_1xHA_sfGFP_scFv_UBQ10_INSULATOR_UBQ10_dCAS9_1xHA_3xNLS_10xGCN422aa_OCS (SunTagFWAg4-22aa) construct was analyzed by BS-seq. Methylation levels of different contexts (CG, CHG and CHH, where H is C, T, or A) are shown. A gray arrow indicates the gRNA4 binding site in the promoter region of FWA.

To test if the late flowering phenotype of a late flowering plant containing the gRNA4_U6_NOS_TET1CD_ 2xNLS_1xHA_sfGFP_scFv_UBQ10_INSULATOR_ UBQ10_dCAS9_1xHA_3xNLS_10xGCN422aa_OCS construct originally described in Table 5A is due to the loss of methylation in the FWA promoter, whole-genome BS-Seq experiments were conducted as described above. The results, presented in FIG. 40 and FIG. 41, show a loss of methylation in the FWA promoter in the plants that contains the gRNA4_U6_NOS_TET1CD_2xNLS_1xHA_sfGFP_ scFv_UBQ10_INSULATOR_UBQ10_dCAS9_1xHA_ 3xNLS_10xGCN422aa_OCS transgene and that this demethylation was specific to the FWA promoter.

Figure 42:
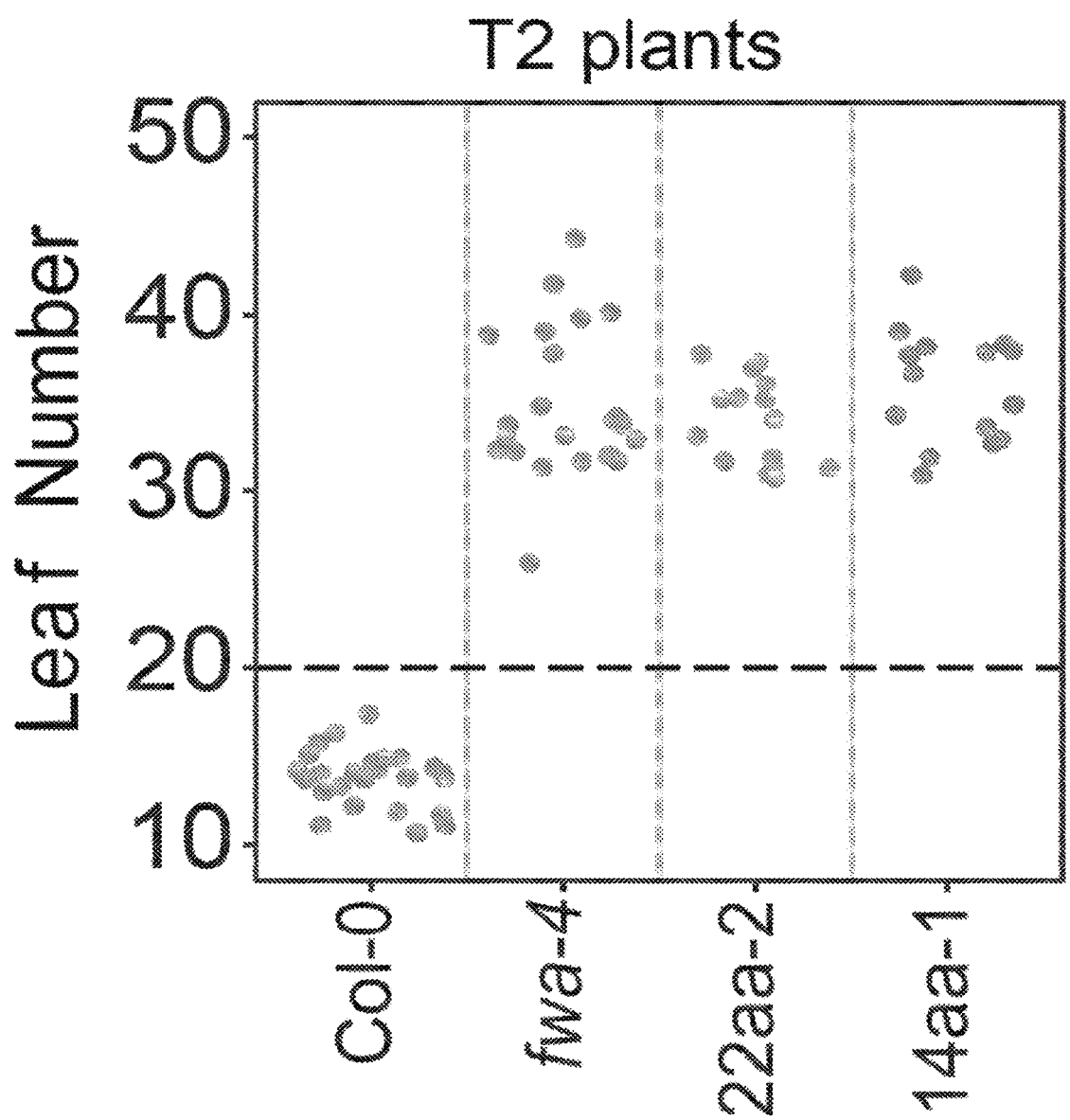
FIG. 42 illustrates the flowering time of Col-0, fwa-4, and the segregating populations of T2 plants that have arisen from T1 plants containing either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene.

To test the heritability of the late flowering phenotype observed in Example 5 in plants containing either the gRNA4_U6_NOS_TET1CD_2xNLS_1xHA_sfGFP_scFv_ UBQ10_INSULATOR_UBQ10_dCAS9_1xHA_3xNLS_ 10xGCN422aa_OCS or the gRNA4_U6_NOS_ TET1CD_2xNLS_1xHA_sfGFP_scFv_UBQ10_INSULA- TOR_UBQ10_dCAS9_1xHA_3xNLS_10xGCN414aa_ OCS transgene, flowering time of a segregating population of T2 plants was assayed. The results, presented in FIG. 42, show that all plants in the T2 generation arising from T1 plants containing either the gRNA4_U6_NOS_TET1CD_ 2xNLS_1xHA_sfGFP_scFv_UBQ10_INSULATOR_ UBQ10_dCAS9_1xHA_3xNLS_10xGCN422aa_OCS or the gRNA4_U6_NOS_TET1CD_2xNLS_1xHA_sfGFP_ scFv_UBQ10_INSULATOR_UBQ10_dCAS9_1xHA_ 3xNLS_10xGCN414aa_OCS transgene also displayed a late flowering phenotype similar to what is seen in the fwa-4 epiallele plants. Thus, even though these T2 plants were segregating 3:1 for the TET1CD containing transgenes, all plants retained the late flowering phenotype, indicative of FWA activation.

Figure 43:
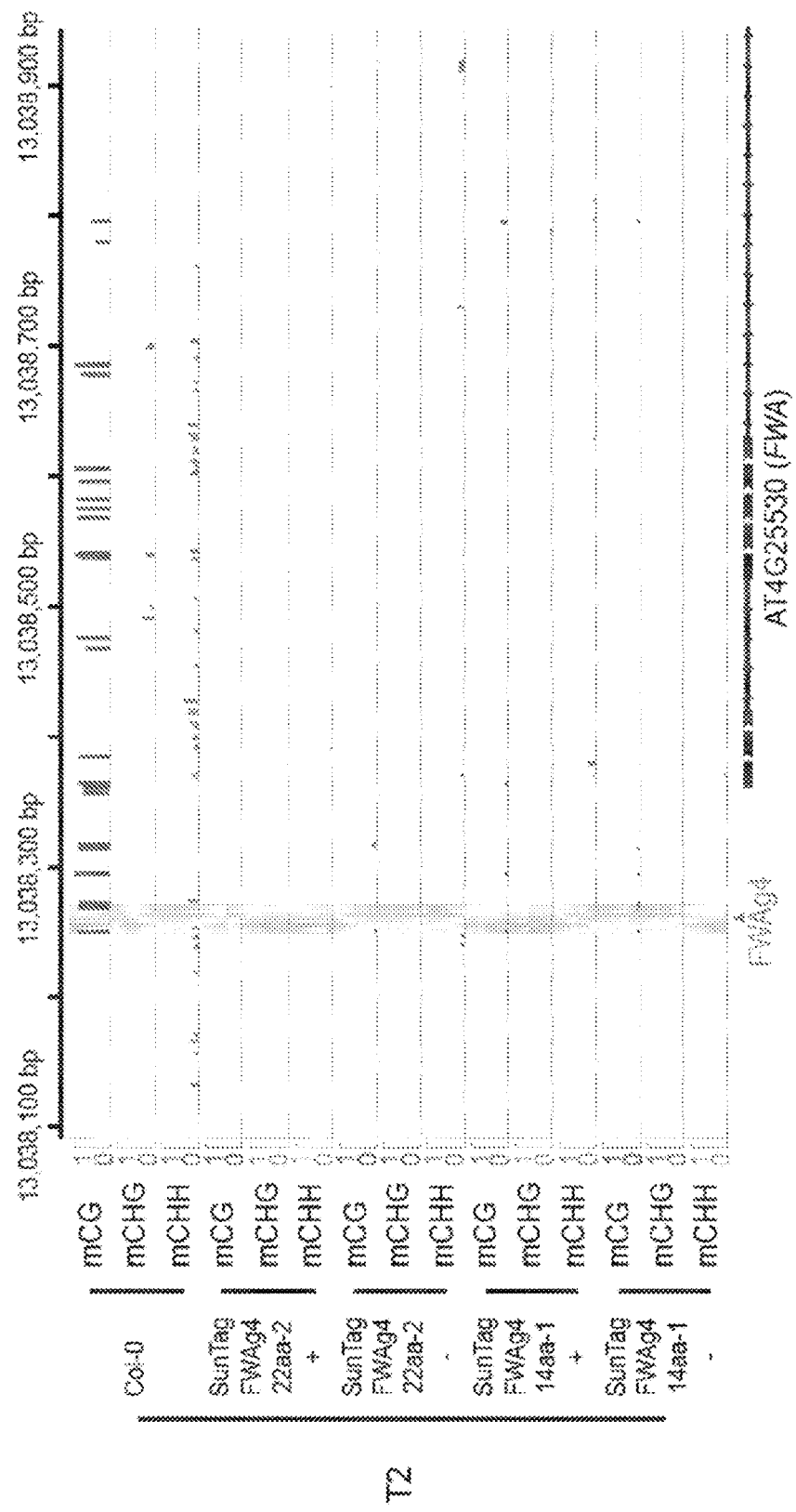
FIG. 43 illustrates Whole Genome Bisulfite Sequencing results. DNA methylation of T2 plants that have either retained the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene (+) or have had the transgenes segregated away (−) were analyzed by BS-seq. Methylation levels of different contexts (CG, CHG and CHH, where H is C, T, or A) are shown. A gray arrow indicates the gRNA4 binding site in the promoter region of FWA.
Figure 44:
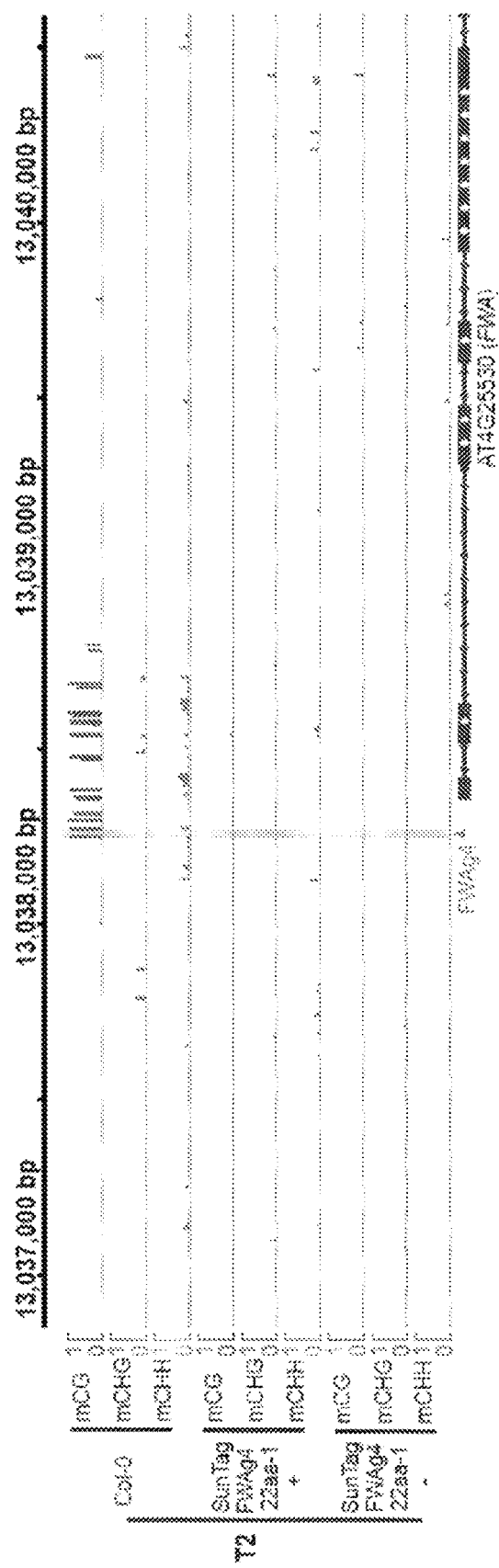
FIG. 44 illustrates Whole Genome Bisulfite Sequencing results. DNA methylation of T2 plants that have either retained the gRNA4_U6_NOS_TET1CD_2xNLS_1xHA_sfGFP_scFv_UBQ10_INSULATOR_UBQ10_dCAS9_1xHA_3xNLS_10xGCN422aa_OCS transgene (+) or have had the transgene segregated away (−) was analyzed by BS-seq. Methylation levels of different contexts (CG, CHG and CHH, where H is C, T, or A) are shown. A gray arrow indicates the gRNA4 binding site in the promoter region of FWA.
Figure 45:
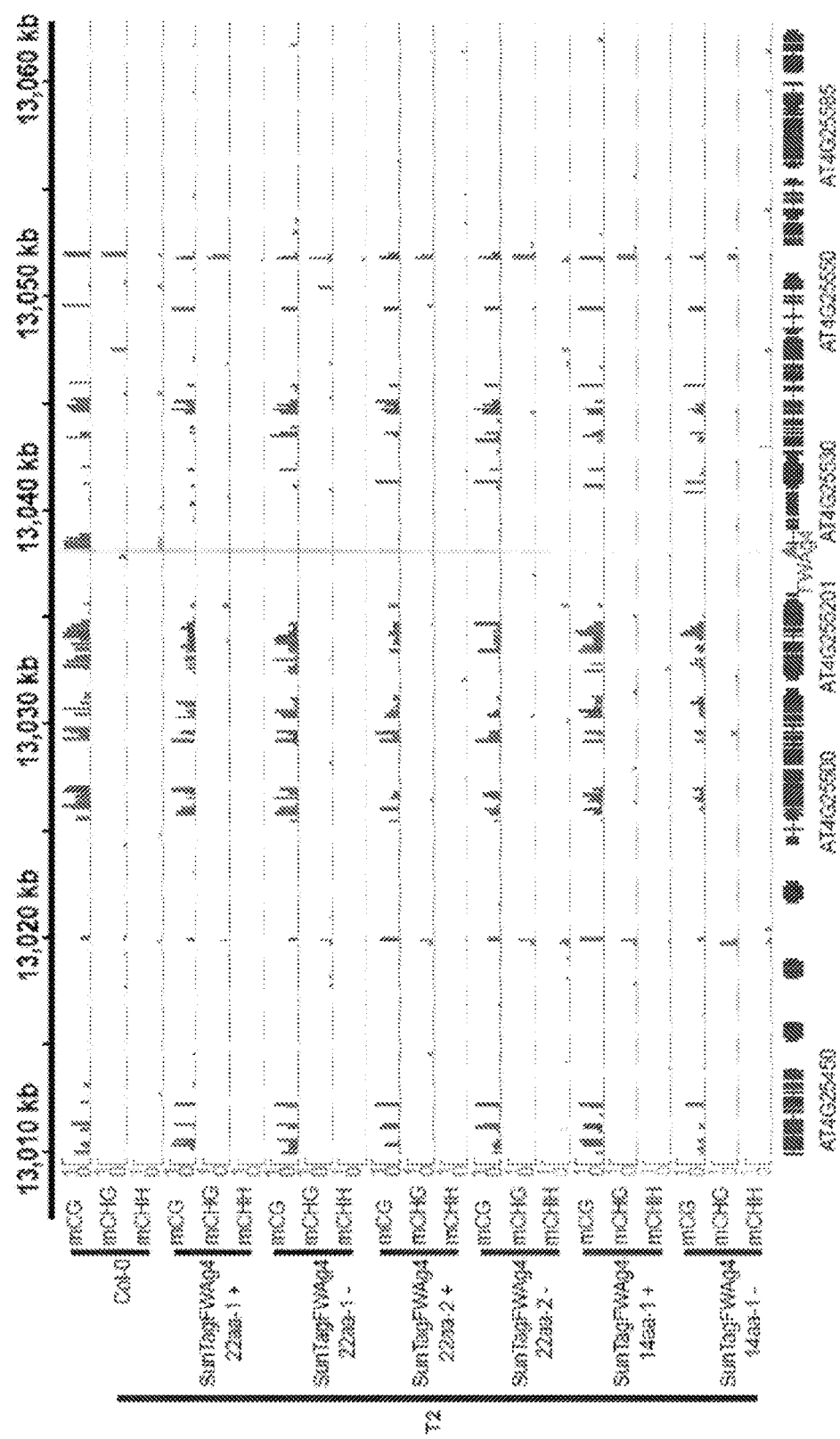
FIG. 45 illustrates a zoomed-out view of the Whole Genome Bisulfite Sequencing results presented in FIG. 43 and FIG. 44. DNA methylation of T2 plants that have either retained the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene (+), or have had the transgene segregated away (−) were analyzed by BS-seq. Methylation levels of different contexts (CG, CHG and CHH, where H is C, T, or A) are shown. A gray arrow indicates the gRNA4 binding site in the promoter region of FWA.
Figure 46:
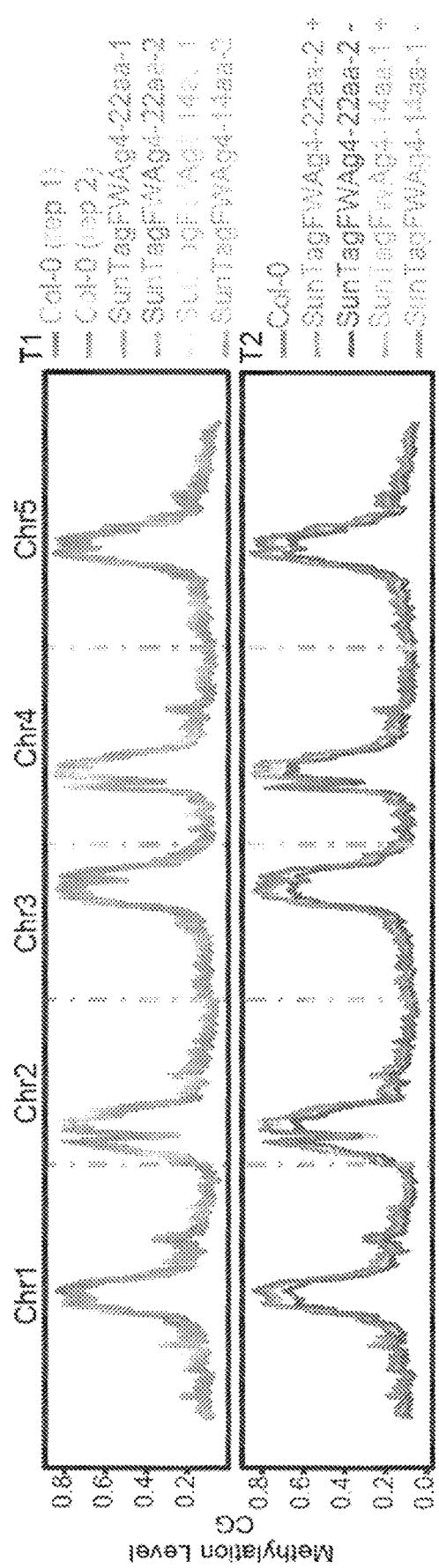
FIG. 46 illustrates the genome-wide CG methylation levels in Col-0, T1 and T2 plants that contain either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene (+), and T2 plants where either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene has been segregated away in the T2 (−).
Figure 47:
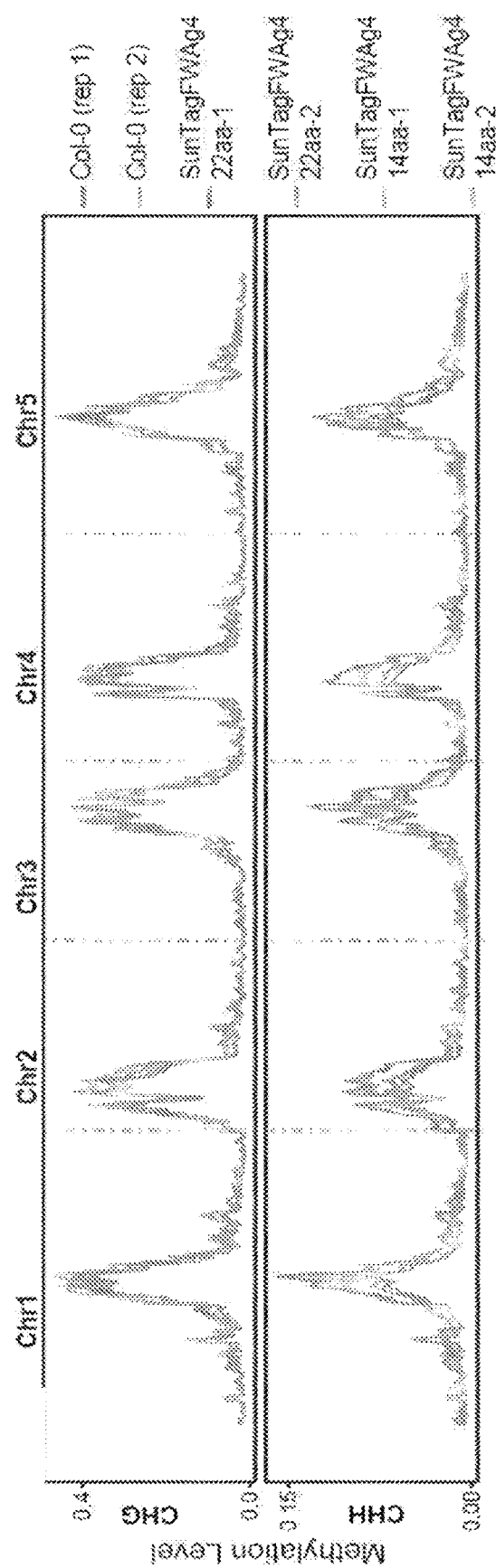
FIG. 47 illustrates the genome-wide CHG and CHH methylation levels in one wild-type Col-0 plant and T1 plants that contain either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene.
Figure 48:
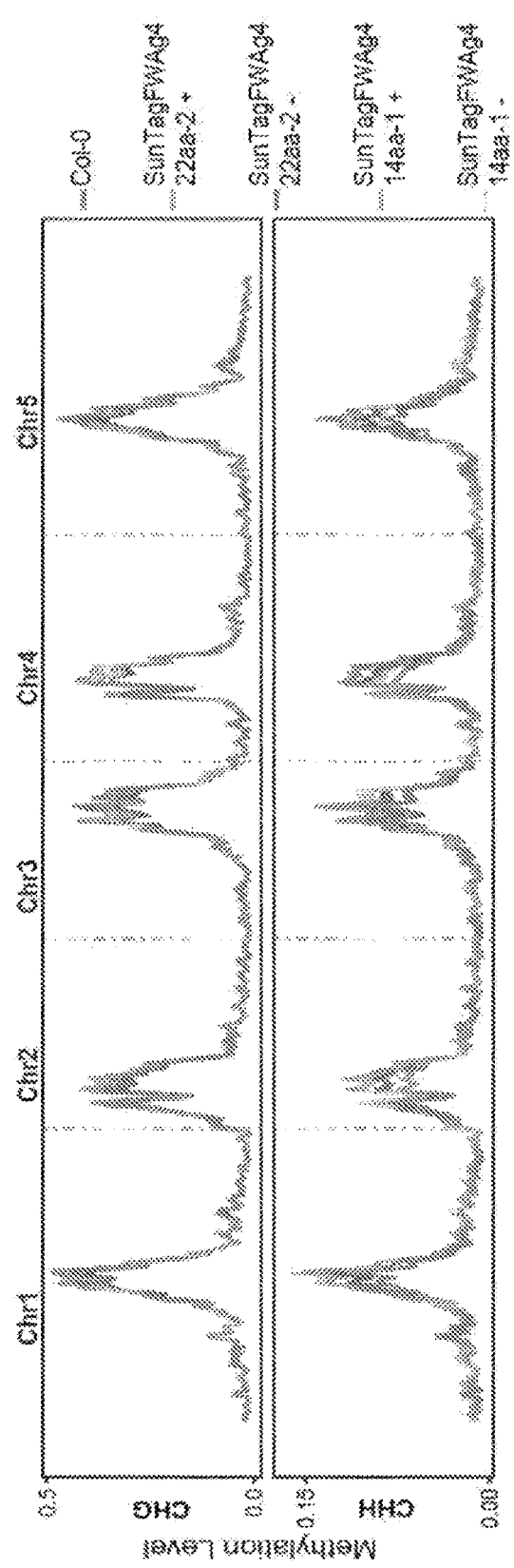
FIG. 48 illustrates the genome-wide CHG and CHH methylation levels in one wild-type Col-0 plant and T2 plants that contain either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene (+), or plants that had segregated away the transgenes (−).
Figure 49:
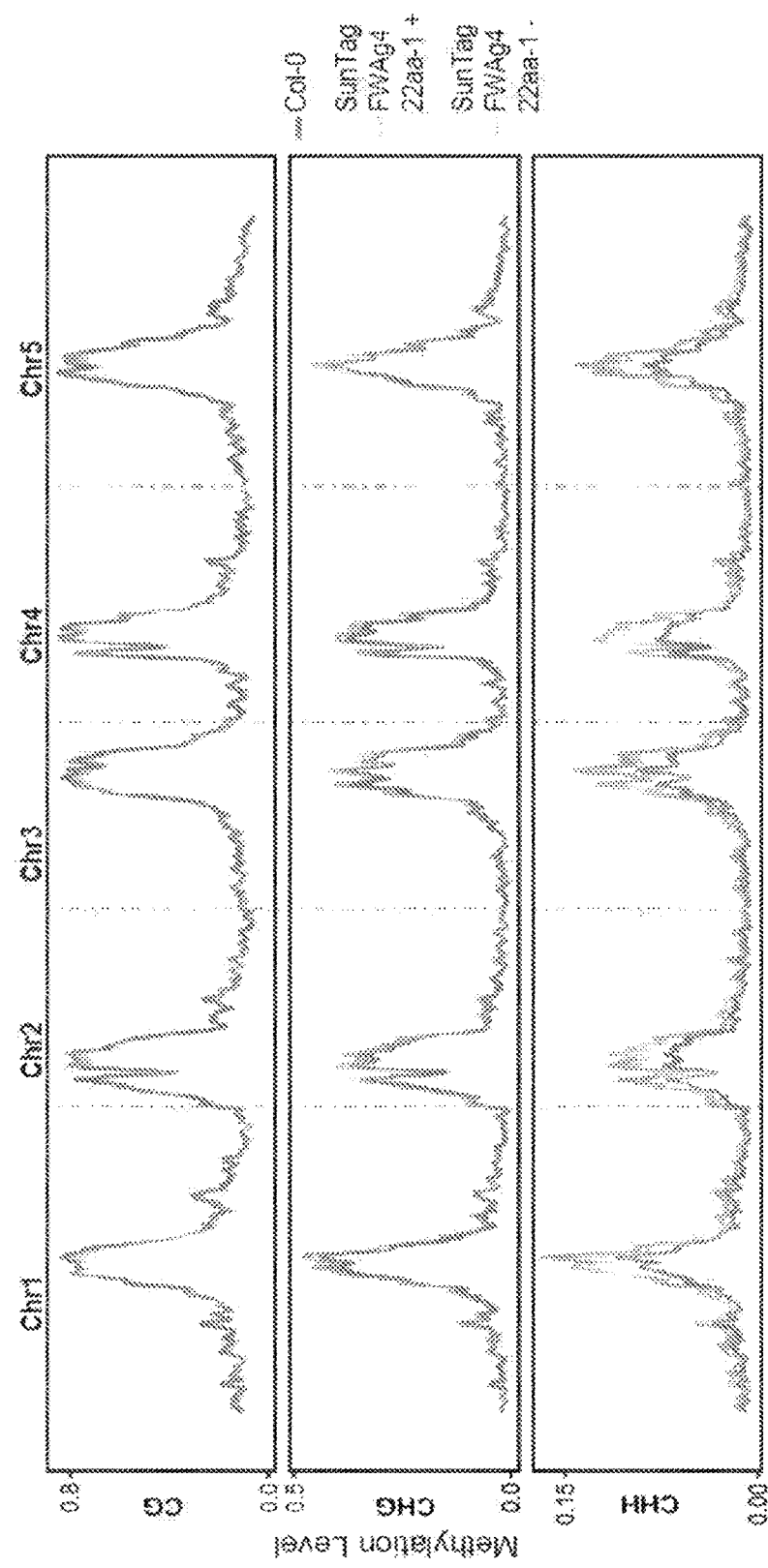
FIG. 49 illustrates the genome-wide CG, CHG and CHH methylation levels in one wild-type Col-0 plant and a T2 plant that contains the gRNA4_U6_NOS_TET1CD_2xNLS_1xHA_sfGFP_scFv_UBQ10_INSULATOR_UBQ10_dCAS9_1xHA_3xNLS_10xGCN422aa_OCS transgene (+) or a T2 plant where the gRNA4_U6_NOS_TET1CD_2xNLS_1xHA_sfGFP_scFv_UBQ10_INSULATOR_UBQ10_dCAS9_1xHA_3xNLS_10xGCN422aa_OCS transgene has been segregated away in the T2 (−).

To test if the late flowering phenotype observed in T2 plants that either contain the gRNA4_U6_NOS_ TET1CD_2xNLS_1xHA_sfGFP_scFv_UBQ10_INSULA- TOR_UBQ10_dCAS9_1xHA_3xNLS_10xGCN422aa_ OCS or the gRNA4_U6_NOS_TET1CD_2xNLS_1xHA_ sfGFP_scFv_UBQ10_INSULATOR_UBQ10_dCAS9_1x HA_3xNLS_10xGCN414aa_OCS transgene, or where the transgene had been segregated away, is due to a loss of methylation at the FWA promoter, whole genome BS-Seq experiments were conducted on individual plants that had retained or lost the transgene in the T2 generation as described above. The results, presented in FIG. 43, FIG. 44, and FIG. 45 show a loss of methylation in the FWA promoter in backgrounds that have either retained the transgene or have had the transgene segregated away. Thus, TET1CD mediated demethylation of FWA is stable in the absence of the transgene, showing that the SunTag TET1CD system can cause heritable changes in DNA methylation. This suggests that the SunTag TET1CD system can potentially be used to create new stable epialleles not found in nature.

To test the specificity of the targeted demethylation caused by the expression of either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or the gRNA4_U6_NOS_TET1CD_2xNLS_1xHA_sfGFP_scFv_UBQ10_INSULATOR_UBQ10_dCAS9_1xHA_3xNLS_10xGCN414aa_OCS systems in T1 backgrounds and T2 backgrounds that retained the transgene or had it segregated away, genome-wide methylation was checked and compared with that of a Col-0 control plant. The results presented in FIG. 46, FIG. 47, FIG. 48, and FIG. 49 show that genome-wide DNA methylation levels were similar between T1 and T2 plants that contain either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene, T2 plants where either the gRNA4_U6_NOS_TET1CD_2xNLS_1xHA_sfGFP_scFv_UBQ10_INSULATOR_UBQ10_dCAS9_1xHA_3xNLS_10xGCN422aa_OCS or gRNA4_U6_NOS_TET1CD_2xNLS_1xHA_sfGFP_scFv_UBQ10_INSULATOR_UBQ10_dCAS9_1xHA_3xNLS_10xGCN414aa_OCS transgene had been segregated away in the T2, and Col-0 control plants. Thus, the demethylation of FWA in the SunTag TET1CD system was very specific.

The results presented in this Example demonstrate that the demethylation caused by the targeting of the TET1 catalytic domain using the SunTag targeting scheme to the FWA locus is specific and heritable. The specificity of this system is important because when using this tool to study locus specific DNA methylation changes, avoiding off target effects reduces any indirect effects on the expression of a locus of interest.

Example 11: Heritability and Specificity of the DNA Binding Domain Targeting of TET1 to the FWA Locus In the present Example, Applicant evaluated the heritability and specificity of the Zinc Finger (ZF) targeting scheme that targets the TET1 polypeptide to the FWA locus in *Arabidopsis* previously described in Example 1.
Materials and Methods
Construction of pUBQ10_ZF108_3xFlag_YPet For this purpose, a modified pMDC123 plasmid (Curtis et al, 2003, Plant Phys) was created, containing 1990 bp of the promoter region of the *Arabidopsis* UBQ10 gene upstream of the BLRP_ZF108_3xFlag cassette. Both UBQ10 promoter and BLRP_ZF108_3xFlag are upstream of the gateway cassette (Invitrogen) present in the original pMDC123 plasmid. YPet was amplified from a YPet containing plasmid and cloned into the pENTR/D plasmid and then delivered to the modified pMDC123 by an LR reaction. The nucleotide sequence of pUBQ10::ZF108_3xFlag_YPet is presented in SEQ ID NO: 158. This expression cassette contains a UBQ10 promoter (SEQ ID NO: 22), the ZF108 DNA-binding domain that targets the FWA promoter (SEQ ID NO: 23), a 3X Flag tag (SEQ ID NO: 24), the YPet expression domain (SEQ ID NO: 159), and an OCS terminator sequence (SEQ ID NO: 26). The pUBQ10::ZF108_3xFlag_YPet expression cassette encodes the ZF108_3xFlag_YPet fusion protein, whose amino acid sequence set forth in SEQ ID NO: 160. Polypeptides in the fusion protein include ZF108 (SEQ ID NO: 28), 3xFlag (SEQ ID NO: 29), and YPet (SEQ ID NO: 161).
Flowering Time Measurement In plants of the T3 generation that have retained the pUBQ10::ZF108_3xFlag_TET1-CD transgene described in Example 1, or have had the transgene segregated away, flowering time was measured and compared to early-flowering wild-type Col-0, homozygous T3 plants carrying the pUBQ10_ZF108_3xFlag_YPet transgene, and late-flowering fwa-4 plants. Flowering time was measured by counting the total number of leaves (rosette and cauline) of each individual plant.
Bisulfite Sequencing and Data Analysis Whole genome bisulfite sequencing (BS-Seq) libraries were generated as previously reported (Cokus et al., 2008) and all libraries were sequenced using the HiSeq 2000 platform following manufacturer instructions (Illumina) at a length of 50 bp. BS-Seq reads were aligned to the TAIR10 version of the *Arabidopsis thaliana* reference genome using BS-map-2.74. For BS-Seq, up to 2 mismatches were allowed and only uniquely mapped reads were used.
Metaplot of WGBS Data Metaplots of WGBS data were made using custom Perl and R scripts. Regions of interest were broken into 50 bins while flanking 1 kb regions were each broken into 25 bins. CG, CHG and CHH methylation levels in each bin were then determined. Metaplots were then generated with R.
RNA-Seq Raw reads in qseq format obtained from the sequencer were first converted to fastq format with a customized perl script. Read quality was controlled with FastQC (http://www.bioinformatics.babraham.ac.uk/projects/fastqc). High quality reads were then aligned to the TAIR10 reference genome using Tophat (Trapnell et al, 2009) (v 2.0.13) by using '-no-coverage-search' option, allowing up to two mismatches and only keeping reads that mapped to one location. Essentially, reads were first mapped to the TAIR10 gene annotation with known splice junctions. When reads did not map to the annotated genes, the reads were mapped to the TAIR10 genome. The number of reads mapping to genes were calculated by HTseq (Anders et al., 2015) (v 0.5.4) with default parameters. Expression levels were determined by RPKM (reads per kilobase of exons per million aligned reads) in R using customized scripts.
Results As previously shown in Example 1, T1 plants containing the pUBQ10::ZF108_3xFlag_TET1-CD transgene were late flowering like fwa-4 plants as compared to Col-0 controls (FIG. 50A). To test if the late flowering phenotypes observed in plants containing the pUBQ10::ZF108_3xFlag_TET1-CD transgene in Example 1 was heritable in the next generation, flowering time of populations of T3 plants that had either retained the pUBQ10::ZF108_3xFlag_TET1-CD transgene or plants where the pUBQ10::ZF108_3xFlag_TET1-CD transgene was segregated away in the T2 were assayed along with Col-0, fwa-4 and T3 plants containing the pUBQ10_ZF108_3xFlag_YPet control transgene. The results, presented in FIG. 50B, show that all plants that have either retained the pUBQ10::ZF108_3xFlag_TET1-CD transgene or where the pUBQ10::ZF108_3xFlag_TET1-CD transgene was segregated away in the T2, showed a later flowering phenotype. This demonstrated that the late flowering phenotype caused by the TET1-CD is heritable even in the absence of the TET1-CD transgene. In addition, control plants expressing a fusion of ZF108 to the fluorescent protein YPet (ZF108-YPet) did not show any effect on flowering time, indicating that the late flowering phenotype observed is not simply a consequence of ZF108 binding to the FWA promoter (FIG. 50B).

To test if the observed late flowering phenotype in T1 plants containing the pUBQ10::ZF108_3xFlag_TET1-CD transgene was due to FWA activation, RNA-seq was performed with one Col-0, one fwa-4, and four independent T1 lines containing the pUBQ10::ZF108_3xFlag_TET1-CD transgene. FIG. 51A shows that FWA is activated in plants containing the transgene to a similar level observed in fwa-4 plants. RNA-seq was also performed with four biological replicates from two independent T3 lines containing the pUBQ10::ZF108_3xFlag_TET1-CD transgene, four biological replicates from two independent T3 lines containing pUBQ10::ZF108_3xFlag_YPet, and four biological replicates of Col-0 control plants. The results presented in FIG. 51B show that FWA was upregulated in all pUBQ10::ZF108_3xFlag_TET1-CD plants tested, but not in the pUBQ10::ZF108_3xFlag_YPet or Col-0 plants. These results, in addition to those shown in FIG. 5 of Example 1, demonstrate that activation of FWA caused by the specific targeting of the TET1 catalytic domain to a genomic region can be heritable over multiple generations. In addition, control plants expressing pUBQ10::ZF108_3xFlag_YPet did not show any effect on FWA expression, showing that the FWA overexpression phenotype observed in pUBQ10::ZF108_3xFlag_TET1-CD plants is not simply a consequence of ZF108 binding to the FWA promoter. RNA-seq data showed very few additional changes and revealed FWA as the most upregulated gene in the ZF108-TET1cd lines as compared to ZF108-YPet control lines (FIG. 52). These results demonstrate successful removal of methylation at the FWA promoter and activation of FWA expression and, importantly, very few off-target effects due to ZF108-TET1cd expression.

To test if the late flowering phenotype observed in the T3 plants was due to a loss of methylation at the FWA promoter, whole genome BS-Seq experiments were conducted on individual plants that had retained or lost the transgene as described above. The results, presented in FIG. 53, FIG. 54, and FIG. 55 show that loss of methylation caused by the specific targeting of the TET1 catalytic domain to a genomic region can be heritable over multiple generations even in plants that have had the pUBQ10::ZF108_3xFlag_TET1-CD transgene segregated away. These results also show that methylation in regions adjacent to FWA showed very little change in methylation, showing that targeting of the TET1-CD to FWA causes highly localized and precise demethylation.

To test the specificity of the targeted demethylation caused by the expression of the pUBQ10::ZF108_3xFlag_TET1-CD system in T1 plants, T3 plants that retained the transgene, or T3 plants that had the transgene segregated away, genome-wide methylation was analyzed and compared with that of a Col-0 control plant. The results presented in FIG. 56, FIG. 57, FIG. 58, and FIG. 59 show that genome-wide DNA methylation levels were similar between all backgrounds examined. In T3 plants that had retained or lost the transgene, methylation levels over protein coding genes and transposable elements were also analyzed. The results presented in FIG. 60 show that over protein coding genes and transposable elements methylation levels were similar among all backgrounds examined. These data show that expression of the TET1-CD in these plants showed very little genome-wide effects on methylation levels.

The results presented in this example demonstrate that the demethylation caused by the targeting of the TET1 catalytic domain using the ZF targeting scheme to the FWA locus is highly specific and heritable. Thus, specific and highly efficient ZF proteins can be designed for targeted demethylation of genomic regions of interest, for both research and agricultural purposes.

Example 12: SunTag Control Transgenes that are not Targeted to a Specific Locus

In the present Example, Applicant used the SunTag targeting scheme without a specific guide RNA to demonstrate that the targeting of demethylation by TET1-CD requires a specific guide RNA and is therefore not caused by non-specific expression of the TET1-CD.

Example 4 describes a SunTag-based targeting scheme to target a TET1catalytic polypeptide to a target nucleic acid. This Example describes a SunTag targeting scheme in which a TET1 polypeptide was not targeted to any locus in *Arabidopsis* using the CRISPR-CAS9 system. A schematic of the targeting system is presented in FIG. 61.

Materials and Methods

Construction of
NOS_TET1CD_2xNLS_1xHA_sfGFP_scFv_UBQ10_ INSULATOR_UBQ10_dCA S9_1xHA_3xNLS_10x GCN422aa_OCS and
NOS_TET1CD_2xNLS_1xHA_sfGFP_scFv_UBQ10_ INSULATOR_UBQ10_dCA S9_1xHA_3xNLS_10x GCN414aa_OCS For this purpose, a dCAS9_1xHA_3xNLS_10xGCN4 that contains a 22aa spacer between epitopes (dCAS9_1xHA_3xNLS_10xGCN422aa) and a dCAS9_1xHA_3xNLS_10xGCN4 that contains a 14aa spacer between epitopes (dCAS9_1xHA_3xNLS_10xGCN414aa) was created through a combination of gene synthesis and the utilization of plasmids from Addgene, and separately cloned into a modified pMTN3164 plasmid downstream of a fragment containing 1994 bp of the promoter region of the *Arabidopsis* UBQ10 gene followed by an omega RBC translational enhancer and upstream of an OCS terminator creating pMTN3164 UBQ10_dCAS9_1xHA_3xNLS_10xGCN422aa_OCS and pMTN3164 UBQ10_dCAS9_1xHA_3xNLS_10XGCN414aa_OCS. An insulator sequence followed by a second fragment containing 1994 bp of the promoter region of the *Arabidopsis* UBQ10 gene was then cloned upstream of pMTN3164 UBQ10_dCAS9_1xHA_3xNLS_10xGCN422aa_OCS and pMTN3164 UBQ10_dCAS9_1xHA_3xNLS_10XGCN414aa_OCS such that transcription of downstream targets resulting from this second UBQ10 promoter would occur opposite the dCAS9_1xHA_3xNLS_10xGCN422aa or dCAS9_1xHA_3xNLS_10xGCN414aa transcription. A scFv_sfGFP_1XHA_2XNLS_TET1CD sequence created through a combination of gene synthesis and the utilization of plasmids from Addgene was then cloned downstream of the second UBQ10 promoter in both vectors creating pMTN3164 TET1CD_2xNLS_1xHA_sfGFP_scFv_ UBQ10_INSULATOR_UBQ10_dCAS9_1xHA_3x NLS_ 10xGCN422aa_OCS and pMTN3164 TET1CD_ 2xNLS_1xHA_sfGFP_scFv_UBQ10_INSULATOR_ UBQ10_dCAS9_1xHA_3x NLS_10xGCN414aa_OCS. A NOS terminator was then cloned downstream of TET1cd in both TET1CD_2xNLS_1xHA_sfGFP_scFv_UBQ10_ INSULATOR_UBQ10_dCAS9_1xHA_3x NLS_10xGCN 422aa_OCS and TET1CD_2xNLS_1xHA_sfGFP_scFv_

UBQ10_INSULATOR_UBQ10_dCAS9_1xHA_3x NLS_ 10xGCN414aa_OCS constructs creating pMTN3164 NOS_TET1CD_2xNLS_1xHA_sfGFP_scFv_UBQ10_ INSULATOR_UBQ10_dCAS9_1xH A_3xNLS_ 10xGCN422aa_OCS and pMTN3164 NOS_TET1CD_ 2xNLS_1xHA_sfGFP_scFv_UBQ10_INSULATOR_ UBQ10_dCAS9_1xH A_3xNLS_10xGCN414aa_OCS constructs.

The expression cassette of NOS_TET1CD_2xNLS_ 1xHA_sfGFP_scFv_UBQ10_INSULATOR_UBQ10_ dCAS9_1xH A_3xNLS_10xGCN422aa_OCS and NOS_ TET1CD_2xNLS_1xHA_sfGFP_scFv_UBQ10_INSULA- TOR_UBQ10_dCAS9_1xH A_3xNLS_10xGCN414aa_ OCS differ only in the 10xGCN4 sequence. These vectors contain a number of features. The nucleotide sequences of NOS_TET1CD_2xNLS_1xHA_sfGFP_scFv_UBQ10_ INSULATOR_UBQ10_dCAS9_1xH A_3xNLS_10xGCN 422aa_OCS and NOS_TET1CD_2xNLS_1xHA_sfGFP_ scFv_UBQ10_INSULATOR_UBQ10_dCAS9_1xH A_ 3xNLS_10xGCN414aa_OCS expression cassettes are pre- sented in SEQ ID NO: 162 and SEQ ID NO: 163, respec- tively. These cassettes are described as single cassettes, but contain different expression regions: (1) one that encodes the dCAS9-10xGCN4 fusion protein and (2) one that encodes the scFv-sfGFP-TET1-CD fusion protein. The cassette includes, a UBQ10 promoter (SEQ ID NO: 108), Omega RBC (SEQ ID NO: 109), dCAS9 (SEQ ID NO: 110), 1xHA (SEQ ID NO: 111), 3xNLS (SEQ ID NO: 112), 2xNLS (SEQ ID NO: 113), linkers (SEQ ID NO: 114), 10xGCN422aa (SEQ ID NO: 115) or 10xGCN414aa (SEQ ID NO: 116), OCS terminator (SEQ ID NO: 117), insulator (SEQ ID NO: 118), scFv (SEQ ID NO: 119), sfGFP (SEQ ID NO: 120), TET1-CD (SEQ ID NO: 121), and NOS terminator (SEQ ID NO: 122).

The amino acid sequence of the polypeptide fusion of dCAS9_1xHA_3xNLS_10xGCN422aa is presented in SEQ ID NO: 123 and the amino acid sequence of the polypeptide fusion of dCAS9_1xHA_3xNLS_10xGCN414aa is pre- sented in SEQ ID NO: 124. Relevant amino acid sequences present in these fusion proteins include, for example: dCAS9 (SEQ ID NO: 125), 1X HA (SEQ ID NO: 126), 3xNLS (SEQ ID NO: 127), linker (SEQ ID NO: 128), and 10xGCN422aa (SEQ ID NO: 129) or 10xGCN414aa (SEQ ID NO: 130).

The amino acid sequence of the polypeptide fusion of scFv_sfGFP_1xHA_2xNLS_TET1CD is presented in SEQ ID NO: 131 and is identical in both NOS_ TET1CD_2xNLS_1xHA_sfGFP_scFv_UBQ10_INSULA- TOR_UBQ10_dCAS9_1xH A_3xNLS_10xGCN 422aa_OCS and NOS_TET1CD_2xNLS_1xHA_sfGFP_ scFv_UBQ10_INSULATOR_UBQ10_dCAS9_1xH A_ 3xNLS_10xGCN414aa_OCS vectors. Relevant amino acid sequences present in this fusion protein include, for example: scFv (SEQ ID NO: 132), sfGFP (SEQ ID NO: 133), 1xHA (SEQ ID NO: 134), 2xNLS (SEQ ID NO: 135), Linkers (SEQ ID NO: 136), and TET1-CD (SEQ ID NO: 137).

Plant Transformation and Flowering Time Measurement

The constructs described above were transformed into Col-0 wild-type plants using *Agrobacterium*-mediated genetic transformation (after the construct was transformed into *Agrobacterium*). This process involves transforming plants via floral dip using methods well known in the art. Progeny of transformed plants (T1s) were screened for Hygromycin resistance. Among the Hygromycin-resistant transgenic plants, flowering time was measured and com- pared to early-flowering wild-type Col-0 and late-flowering fwa-4 plants. Flowering time was measured by counting the total number of leaves (rosette and cauline) of each indi- vidual plant.

Bisulfate Sequencing and Data Analysis

Whole genome bisulfite sequencing (BS-Seq) libraries were generated as previously reported (Cokus et al., 2008) and all libraries were sequenced using the HiSeq 4000 platform following manufacturer instructions (Illumina) at a length of 50 bp. BS-Seq reads were aligned to the TAIR10 version of the *Arabidopsis thaliana* reference genome using BS-map-2.74. For BS-Seq, up to 2 mismatches were allowed and only uniquely mapped reads were used.

Metaplot of WGBS Data

Metaplots of WGBS data were made using custom Perl and R scripts. Regions of interest were broken into 50 bins while flanking 1 kb regions were each broken into 25 bins. CG, CHG and CHH methylation levels in each bin were then determined. Metaplots were then generated with R.

Results

To test if NOS_TET1CD_2xNLS_1xHA_sfGFP_ scFv_UBQ10_INSULATOR_UBQ10_dCAS9_1xH A_ 3xNLS_10xGCN422aa_OCS or NOS_TET1CD_ 2xNLS_1xHA_sfGFP_scFv_UBQ10_INSULATOR_ UBQ10_dCAS9_1xH A_3xNLS_10xGCN414aa_OCS can trigger demethylation and reactivate FWA expression, wild- type Col-0 plants were transformed with the NOS_TET1CD_2xNLS_1xHA_sfGFP_scFv_UBQ10_ INSULATOR_UBQ10_dCAS9_1xH A_3xNLS_ 10xGCN422aa_OCS or NOS_TET1CD_2xNLS_1xHA_ sfGFP_scFv_UBQ10_INSULATOR_UBQ10_dCAS9_1xH A_3xNLS_10xGCN414aa_OCS transgene described above. Flowering time of T1 transgenic plants was assayed. The results, presented in FIG. 62, show that all T1 plants containing either the NOS_TET1CD_2xNLS_1xHA_ sfGFP_scFv_UBQ10_INSULATOR_UBQ10_dCAS9_1xH A_3xNLS_10xGCN422aa_OCS or NOS_TET1CD_ 2xNLS_1xHA_sfGFP_scFv_UBQ10_INSULATOR_ UBQ10_dCAS9_1xH A_3xNLS_10xGCN414aa_OCS transgene displayed an early flowering phenotype similar to that of Col-0 wild type plants. Thus, even though these T1 plants contained the NOS_TET1CD_2xNLS_1xHA_ sfGFP_scFv_UBQ10_INSULATOR_UBQ10_dCAS9_1xH A_3xNLS_10xGCN422aa_OCS or NOS_TET1CD_ 2xNLS_1xHA_sfGFP_scFv_UBQ10_INSULATOR_ UBQ10_dCAS9_1xH A_3xNLS_10xGCN414aa_OCS transgene, effects on flowering time were not observed, ruling out the possibility of non-specific FWA reactivation due to these transgenes when a gRNA is not present.

To test if the early flowering plants containing the NOS_TET1CD_2xNLS_1xHA_sfGFP_scFv_UBQ10_ INSULATOR_UBQ10_dCAS9_1xH A_3xNLS_10xGCN 422aa_OCS or NOS_TET1CD_2xNLS_1xHA_sfGFP_ scFv_UBQ10_INSULATOR_UBQ10_dCAS9_1xH A_ 3xNLS_10xGCN414aa_OCS transgene described in FIG. 61 show any loss of methylation in the FWA promoter or the CACTA1 promoter (described in Example 6), whole-ge- nome BS-Seq experiments were conducted as described above. The results presented in FIG. 63 show that plants containing the NOS_TET1CD_2xNLS_1xHA_sfGFP_ scFv_UBQ10_INSULATOR_UBQ10_dCAS9_1xH A_3x NLS_10xGCN422aa_OCS or NOS_TET1CD_ 2xNLS_1xHA_sfGFP_scFv_UBQ10_INSULATOR_ UBQ10_dCAS9_1xH A_3xNLS_10xGCN414aa_OCS transgene show a level of methylation in the FWA promoter similar to that seen in the Col-0 wild type background. The results presented in FIG. 64 show that plants containing the NOS_TET1CD_2xNLS_1xHA_sfGFP_scFv_UBQ10_

INSULATOR_UBQ10_dCAS9_1xHA_3xNLS_10xGCN 422aa_OCS transgene show a level of methylation in the CACTA1 promoter similar to that seen in the Col-0 wild type background.

To test if the plants containing the NOS_TET1CD_2xNLS_1xHA_sfGFP_scFv_UBQ10_INSULATOR_UBQ10_dCAS9_1xHA_3xNLS_10xGCN422aa_OCS or NOS_TET1CD_2xNLS_1xHA_sfGFP_scFv_UBQ10_INSULATOR_UBQ10_dCAS9_1xHA_3xNLS_10xGCN414aa_OCS transgene showed any genome-wide changes in CG, CHG or CHH methylation levels caused by the expression of the NOS_TET1CD_2xNLS_1xHA_sfGFP_scFv_UBQ10_INSULATOR_UBQ10_dCAS9_1xHA_3xNLS_10xGCN422aa_OCS or NOS_TET1CD_2xNLS_1xHA_sfGFP_scFv_UBQ10_INSULATOR_UBQ10_dCAS9_1xHA_3xNLS_10xGCN414aa_OCS transgene, genome-wide methylation levels were checked and compared with that of a Col-0 control plant. The results presented in FIG. 65 show that genome-wide DNA methylation levels across the entire genome were similar among all backgrounds examined.

The results in this Example show that that expression of SunTag TET1-CD constructs without any specific guide RNAs show little effect on DNA methylation at specific loci or in the genome in general. These results further underscore that the SunTag TET1-CD systems is highly specific for the targeted locus. This SunTag system can therefore be used to specifically target single loci for targeted DNA methylation, or a multiplexing strategy can be taken to specifically and efficiently target multiple loci simultaneously.

Example 13: Targeting the Catalytic Domain of a TET2 or TET3 Polypeptide to a Target Nucleic Acid This Example describes exemplary protocols for targeting the catalytic domain of a TET2 polypeptide or a TET3 polypeptide to a target nucleic acid to induce demethylation of the target nucleic acid.

Materials and Methods for this targeting are generally analogous to those described in prior examples. For DNA-binding domain based targeting, the methods outlined in Example 8 may be applied. For SunTag based targeting, the methods outlined in Example 6 may be applied. The catalytic domain of TET1 (TET1-CD) may be replaced with the catalytic domain of TET2 (e.g. SEQ ID NO: 192) or the catalytic domain of TET3 (e.g. SEQ ID NO: 194).

Following vector construction and plant transformation, an exemplary target nucleic acid (e.g. FWA) may be assayed via expression analysis such as qPCR to evaluate the level of expression of the target nucleic acid. Bisulfite sequencing may be used to probe the methylation status of the target nucleic acid.

It is expected that targeting the catalytic domain of TET2 or TET3 to a target nucleic acid in plants will result in decreased methylation of the target nucleic acid.

REFERENCES

Tet proteins can convert 5-methylcytosine to 5-formylcytosine and 5-carboxylcytosine. Ito S, Shen L, Dai Q, Wu S C, Collins L B, Swenberg J A, He C, Zhang Y. Science. 2011 Sep. 2; 333(6047):1300-3. doi: 10.1126/science.1210597. Epub 2011 Jul. 21.
Hydroxylation of 5-methylcytosine by TET1 promotes active DNA demethylation in the adult brain.Guo J U, Su Y, Zhong C, Ming G L, Song H. Cell. 2011 Apr. 29; 145(3):423-34. doi: 10.1016/j.cell.2011.03.022. Epub 2011 Apr. 14.
SRA- and SET-domain-containing proteins link RNA polymerase V occupancy to DNA methylation. Johnson L M, Du J, Hale C J, Bischof S, Feng S, Chodavarapu R K, Zhong X, Marson G, Pellegrini M, Segal D J, Patel D J, Jacobsen S E. Nature. 2014 Mar. 6; 507(7490):124-8. doi: 10.1038/nature12931. Epub 2014 Jan. 22.
A CRISPR-based approach for targeted DNA demethylation. Xu X, Tao Y, Gao X, Zhang L, Li X, Zou W, Ruan K, Wang F, Xu G L, Hu R. Cell Discov. 2016 May 3; 2:16009. doi: 10.1038/celldisc.2016.9. eCollection 2016.
Editing DNA Methylation in the Mammalian Genome. Liu X S, Wu H, Ji X, Stelzer Y, Wu X, Czaudema S, Shu J, Dadon D, Young R A, Jaenisch R. Cell. 2016 Sep. 22; 167(1):233-247.e17. doi: 10.1016/j.cell.2016.08.056.
Inheritable Silencing of Endogenous Genes by Hit-and-Run Targeted Epigenetic Editing. Amabile A, Migliara A, Capasso P, Biffi M, Cittaro D, Naldini L, Lombardo A. Cell. 2016 Sep. 22; 167(1):219-232.e14. doi: 10.1016/j.cell.2016.09.006.
Targeted DNA demethylation in vivo using dCas9-peptide repeat and scFv-TET1 catalytic domain fusions. Morita S, Noguchi H, Horii T, Nakabayashi K, Kimura M, Okamura K, Sakai A, Nakashima H, Hata K, Nakashima K, Hatada I. Nat Biotechnol. 2016 Aug. 29. doi: 10.1038/nbt.3658
CRISPR-dCas9 mediated TET1 targeting for selective DNA demethylation at BRCA1 promoter. Choudhury S R, Cui Y, Lubecka K, Stefanska B, Irudayaraj J. Oncotarget. 2016 Jun. 23. doi: 10.18632/oncotarget.10234. [Epub ahead of print]
Induced DNA demethylation by targeting Ten-Eleven Translocation 2 to the human ICAM-1 promoter. Chen H, Kazemier H G, de Groote M L, Ruiters M H, Xu G L, Rots M G. Nucleic Acids Res. 2014 February; 42(3): 1563-74. doi: 10.1093/nar/gkt1019. Epub 2013 Nov. 4.
Targeted DNA demethylation and activation of endogenous genes using programmable TALE-TET1 fusion proteins. Maeder M L, Angstman J F, Richardson M E, Linder S J, Cascio V M, Tsai S Q, Ho Q H, Sander J D, Reyon D, Bernstein B E, Costello J F, Wilkinson M F, Joung J K. Nat Biotechnol. 2013 December; 31(12):1137-42. doi: 10.1038/nbt.2726. Epub 2013 Oct. 9.
Trapnell, C., Pachter, L. & Salzberg, S. L. TopHat: discovering splice junctions with RNA-Seq. *Bioinformatics* (Oxford, England) 25, 1105-1111 (2009).
Anders, S., Pyl, P. T. & Huber, W. HTSeq—a Python framework to work with high-throughput sequencing data. *Bioinformatics* (Oxford, England) 31, 166-169 (2015).
Xie, X et al, Boosting CRISPR/Cas9 multiplex editing capability with the endogenous tRNA-processing system. 2015, Proc Natl Acad Sci USA. 2015 Mar. 17; 112(11): 3570-5
Pastor W. A., Aravind L., Rao A. TETonic shift: biological roles of TET proteins in DNA demethylation and transcription. Nat Rev Mol Cell Biol. 14, 341-356 (2013).
I to S., D'Alessio A. C., Taranova O. V., Hong K., Sowers L. C., Zhang Y. Role of Tet proteins in 5mC to 5hmC conversion, ES-cell self-renewal and inner cell mass specification. Nature 466, 1129-1133 (2010).
Hashimoto et al, 2014 Feb. 20: 506(7488):391-5
Ito et al, Nature, 2010, Aug. 26: 466(7310): 1129-1133

SEQUENCE LISTING (201 sequences)

SEQ ID NO: 1 - protein, 2136 aa, Homo sapiens
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHKNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTIQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 2 - protein, 2136 aa, Pan paniscus
  VARIANT 23: Xaa = Any Amino Acid
MSRSRHARPSRLVRKEDVNKKRXNSQLRKTTKGANKNVASVKTLSPGKLKQLIQERDVKKKTEPKPPMPVRSLLTRAGAARMNLDRTEVLFQNPESLTCNGFTMALRSTSLSRRLSQPPLVIAKSKKVPLSKGSEKQHDCDYKILPDLGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGVAQLSQAGPSKSDRGSSHVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFENKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHNNAMSSVATDMSCDHLKGRSNVLVFQQPGFNCSSIPHSSHSIINHHASIHNEGDQPKTPDNIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTIQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHHRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPCRKKRTCFTQPVPRSGKKRAAMMTEVLAHKIRAVEKKPIPRIKRKNNSTTTNNSKASSLPTLGSKTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 3 - protein, 2136 aa, Gorilla gorilla gorilla
MSRSRHARPSRLVRKEDVNKKKKNSQLRNTTKGANKNVASVKTLSPGKLKQLIQERDVKKKTEPKPPMPVRSLLTRAGAARMNLDRTEVLFQNPESLTCNGFTMALRSTSLSRRLSQPPLVVAKSKKVPLSKGLEKQHDCDYKILPDLGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSNQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLASERGLFHASLGVAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVAVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTIRNGIKHVHCLPAETNVSFKKFNIEEFGKTLENNSYKFLKDTANHNNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVENTPTSLVTCNVQQKYNQEKGTIQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSREGMEAKIKSGAIEVLAPCRKKRTCFTQPVPRSGKKRAAMMTEVLAHKIRAVEKKPIPRIKRKNNSTTTNNSKASSLPTLGSKTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLVNSEPSTGVTEPLTPHQPNHQPSFLTSPQDLASSPMEEDEQHSEADEPPSDEPLSDDLLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 4 - protein, 2132 aa, Mandrillus leucophaeus
MSRSRHARPSRLVRKEDVNKKKKNSQLRKTTKGANKNVASVKTLSPGKLKQLIQERDVKKKTEPKPPMPVRSLLTRAGAARMNSDRTEVLFQNPESLTCNGFTMALRSTSLSRRLSQPPLVIAKSKKVPLSKSLEKQHDCDYKILPDLGVKHSENDSVPMQDTQVLPDIETLISIQNPSLLKGKSQETTQSWSQRVEDSKINIPTHSGPAAEILPGPLEGTCCDEGLFSEETFNDTSGSPKMFAQDTVCAPFPQRATPRVTSQGNPSIQLEELGSRVESLKLSDSYLDPIKSEHNCYPTSSLNKVIPELNLRNCLALGGSTSPTSVIKFLLAGSKQATLGAKPDHQEAFKATANQQEVSDTTSFLGQAFGAIPHQWELPGADPVHGEALRETPDLPEIRGAIPVQGEVFGTILDQQETLGMSGSVVPDLPVFLPVSPNPVATFNAPSKWPEPQGAVSYGLAVQGAIQILPLGSGHTPQSSSISEKNSLPPVMAISNVENEKQVHISFLPANTQGFPLAPERGLFHASLGMAQLSQAGPSKSDRGSSQVSVTSTVHVVNTTVVTIPVPMVSTSSSSYTTLLPTLEKKKRKRCGVCEPCQQKTNCGECTYCKNRKNSHQICKKRKCEELKKKPSVLVPLEVIKENKRPQREKKPKVLKADFDNKPVNGPKSESMDYSRCGHGEEQKLELNPHPVENVTKNEDSMTGIEVEKWTQNKKSHLTDHVKGDFSANVPEAEKSKNSEVDKKQTKSPKLFVQTIRNGIKHVHYLPAETNVSFKKFNIEEFGKTLENSSYKFPKDTANHNNAMSSVATDMSCDHLKGRSNVLVFQQPGFNCNSIPHSSHSNIHRHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPQKLHHCPSLEKQSSCNTVVFNGQANSHISSATNQASTKSHEYSKLTNSLSLFIPKSNSPKIDTNKSIAQGIITLDNCSNDLHQLPPRNNEVEYCNQLLDSSKNLDSDDLSCQDATHTQIEEDVATQLTQLASIIKFNYIKSEDKNVESTPTSLVTCNAQQKYNQEKGTIQQKPPSSVHNNHGSSLTKQKNPTQKKTKSTPSRERRKKKPTVVSYQENDQQKWEKLSYMYGTICDIWIASKFQNFGQFCPHDFPTVFGKISSSTKIWKPLAQTRSIMQPKTVFPPLTQIKLQRYPESAEEKMKVEPLDSLSLFHLKTESNGKAFTDKAYNSQVQLTVNANQKAHPLTQPSSPPHQCANVMAGDDQIRFQQVVKEQLMDQRLPTLPGISQETPLPESALTLRNVNVVCSGGITVVSTKSEEEVCSSSVGTSEFSTVDSAQKNFNDYAMNFFTNPTKNLVSVTKDSELPTCNCLDRVIQKDKGPYYTHLGAGPSVAAVREIMENRYGEKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRVKRKNNSTTTNNSKASPLPALGSKTETVQPEVKSETEPHFILKSSDNTKTYSLMPSAPHPVKEASPVFSWSPKTASATPAPLKNDAAASCGFSERSSTPHCTMSSGRLSGANAAAVEGPGISQLGEAAPLPTLSAPVMEPLVNSEPPTGVTEPLTSHQPNHQPSFLTSPQDLDSSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPELSSEVNELNQIPSHKALTLTHDNVVTVSPYALTHVAGPYNHWV

SEQ ID NO: 5 - protein, 1809 aa, Equus caballus
  VARIANT 1021, 1036: Xaa = Any Amino Acid
MSRSRHARPSRLVRREDLNKKKNSQLKKTSKPANKNGASVKTVSPGKLKQLIQERDVKKKPEPKPPVPVRSLLTRAGAARMNLDRTEVLFQNPESLTCNGFTMALRSTSLSRRLSQPPVVIAKPKKVPPPKSLEKQHECDYKVLTDMGVKHSENDFVPIQDPLIPPDLENLISLQNASLIKGESQETTQSWSQRVEDSKINISTHSGPAAEILSGSLEGTPGGEGLFSQETSSDISDSPKMFARGTLCAPLLQRAALKVTSEGNASIQLEDLGSRVESLKLSDSYLDPIKSEHDFCPTSSFNKVIPELDLKNCLSIGGSIYPTSLIKLLLAGSEQETLGAKPGHQEVLKATPDHREVPDTTPVVRQVFNTVPHQWEVPGANLVLGEALGETPDPPEIPGAVPVQGKVFGAILNQQIPGMGGGTASDPPIFLPAPLNPIATYNALPEWPEPQGTVSYGLEVQGTMQILPLGSGHTPLPSSNSEISSIPPVMAISNIENEKQVHISFLPANTQGFTLAPERGLHRASQGIAQLSQAGPSKWEEESSQISKTSMVDINTTVVSRPVSLASTSSSLSYTTLLPTLEKKKRKRCGVCEPCQQKTNCGECTYCKNRKNSHQICKRRKCEELKKKPSVIVSLEVIKENKRPQREKKPKVLKADFDNKPVNGPKSESMEYSRCGHGEEQRLELNPHPLENVTKNEESMTGVEVEKWTQNKKSHLTDHVKGEFKAIVTEAEKLKNSDGDRKKVLLTDLLEPQKLFAQTVRNGIKNVHYLSTETNVSFKKFNIEEFGKAFENNSYKFLKDTANHNNAMSSIATSASCDHLKGRSNVLVFQKPGFNCKSFSDSANFNLNSHASTTNGSEQPKSLENIPSKEPKDGSPVQPSLLSLMKDRRLTLEQVVAIEALTQLSEAPSENSSPSKSEKDEETEQRTASLLNSCKAILYSVRKDLQDTNLQGEPQSLHHCPSLEKQSSCNTVVFNGQNIIQTNAMAGDDQTQFQQDVKDQLMHQRLPTLPGISHEPPLPDXAQILRNVNVVCSGGXTVVSTKSEEDVCSSSVGVSEFSPVDSAQKSFNDYAMTFFTNSTKNLVSTTKDSELPTCNCLDRVIQKDKGPYYTHLGAGPSVAAVREIMENRYGQKGNAVRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYEHVARECRLGSKEGRPFSGVTACLDFCAHPHRDIHNMNNGSTVVCTLTREDNRSLGVIPQDEQLHVLPLYKLSDTDEFGSREGMEAKIKSGAIEVLTPRRKKRTRFTQPVPRSGKKRAAMMTEVLAHKIRAVEKKFIPRIKRKNNSMTNSSKTSSLPLLGSKTETLQPEIKSETEPHFIVKDLDNTKTYSLTPSIPHPVKEANLSPGFPWSCNTASATTVPFKDGASDPYGFSERGSNPHCTMPSARHSGANAAAGECTGSAQPGEVVPLPTLSTPVTDSLVYSEPPTGPSEQLTSNQPNQQPPFITSPHELASSLVEEDEQHSEVDEPLSDDPLSDDALSPAEEKLPHIDEYWSDSEHIFLDANIGGVAIAPAHGSVLIECARRELHATTPVENPNRNHPTRLSLVFYQHKNLNKPQHGFELNKIKFEAKEAKNKKIKASEQKDQAANEGPELCPEVNELNQIPSHKALTLTHDNVVTVSPYALTHVAGPYNHWV

SEQ ID NO: 6 - protein, 2137 aa, Canis lupus familiaris
MSRSRHARPSRLVRREDLNRKKSTQLKKTCKAANKNVASVKTVSPGKLKQLIHERDVKKKIEPKPPMPVRSLLTRAGAARMNLDRTEVLFQNPESLTCNGFTMALRSTSLSRRLSQPPVIIAKPKKVSPPKNLEKQHECDYNVVTDMGVKHAENDSVPTQVPLITPEIENLIGVQNASLIKDESQEIAQSWSQRVDDSKINISTHSGPAGESLSGSSEGTRGGEGLFSKETLNDISDSPRMFAQDTLCAPLLQRAALKVTYEGNSSIQLEDLGSRVESLKLSDSYPDPIKSERDCYPTSSFNKIIPELDLRNCLSIDGSIYPTSLIKLLLASSEQETLGAKPDHREILKATADQQEIPDTTPVIGQAFSAVPHRWEIPGANIIHGEALDETLDPPEMPGAVSVQGEVFGAILNQQILGMGGGTASDPPMFLPPLNPIATYNVPPEWPEPQSTVSYGLEVQGAVQILPLGSGHTPQPPSNSEISSVPPIMTISNIENEKQVHISFLPANIQGITLAPERGLLLHASQGITQLSQAGPSTLEGESSQVSMTSVVDINTKVVSRPVSLASTPSSSFTTLLPTLEKKKRKRCGVCEPCQQKTNCGECTYCKNRKNSHQICKKRKCEELKKKPSVIVPLEVIKENKRPQREKKPKVLKADFDNKSVNGLKSESMEYRRSYGGEQRLELNPPPLENVTKNEESMTGIEVEKWTQNKKSHLTDHVKGEFKAIVTEAEKFKNSEDDKKKVLLTDLIEPQKLFAQTIRNGIKNVHYLPTETNVSFKKFNIEEFGKAFENNSYKFLKDTANHNAMSSIATSASCDHLKGRNNVSVFQKPGFNCKSLPDPTTFNLNSHTSTHNESDQPKSLDNIPSKDPKDGSPVQPSLLSLMKDRRLTLEQVVAIEALTQLSEAPSENSSPSKSEKDEETEHRTESLLNSCKAILYSVRKDLQDPNLQGEPESLHHYPSLEKQTSCNTVVFNGQNISKSHHNSAANQAPTKSQECSKATNSITLFIPNSNSSKIDTNKNVAQSRINLESSKNLHPLPPAGDKLGYCNQSLASSKKIDLKDDPSGLNTIHSKIEEDVATQLTQLASIIKFNYIKQEDKKVESTPTSLVAYNVQQKCSQEKATIQQKPPSSVQNNHSSLLTKQKNTTQKKTRATPSRDRRKKKTVVISCQENDQKNQEQLSYEYSKLHDIWIASKFQRFGQFGPHDFPILLGKIPPLTKVWKPLTQTSSVLEHKKLFPPLTQIKFERYYPELAQERNMKVEPLDSLPICQLKTESNGQAFTEKVYSSQVQPTGNVNQKAHPLLQPSSPTNQCANVMTGDDQTQFQRDVQDQLMHQRLPTLPGISHETPLPDPAHILRNVNVVCSGGITVVSTKNEEDVCSSSVGASEFSPVDSAQKSFNDYAMNFFTNPTKNLVSTTKDSDLPTCNCLDRVIQKDKGPYYTHLGAGPSVAAVREIMENRYGQKGNAIRIEIVVYTGKEGKSSHGCPIAKWVLRRGSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYEHVARECRLGSKEGRPFSGVTACLDFCAHPHRDIHNMNNGSTVVCTLTREDNRSLGVIPQDEQLHVLPLYKLSDTDEFGSREGMEAKIKSGAIEVLTPRRKKRKRFTQPVPRSGKKRAAMMTEVLAHKIRAVEKKFVPRVKRKNNSTSNGKTSSLPLLGNKTEALQLEIKSETEPHFIFKGSDNTKTYSLTPSIPHTLKEANISPGFSWSPKTTSATTAPFKNDVSVSYGFSERSSNPHCTMPSARHSGANAAAGECTGIAQPGEVVALSTLSTPVTESLVYSEPSTGPSEQLPSNHPNQQAPFTTSPHDLTSSLVEEDEQHSDADEPLSDDPLSDDPLSPTEEKLPHIDEYWSDSEHIFLDANIGGVAIAPAHGSVLIECARRELHATTPVEHPNRNHPTRLSLVFYQHKNLNKPQHGFELNKIKFEAKEAKNKKIKASEQKDQAANEVPDLSPEVNELNQIPSHKALTLTHDNIVTVSPYALTHVAGPYNHWV

SEQ ID NO: 7 - protein, 1749 aa, Ovis aries
MGSGTASDPPIFLPAPHNPVATCNALPAWPEPQGTVSSGLEVPDTMQILPSGSGHTPQPSSNSEIILVPPVIPMNNIENEKKVHISLLPAHTQGFTLAPERGLQPAPQGIAQLSLVSPSTLEGRSSQVSATSMVDINTTVVSRPVPLASTSSPSYTTLLPTLEKKKRKRCGVCEPCQQKTNCGECTYCKNRKNSHQICKKRKCEELKKKPSVIVSLEVVKENKRPQREKKPKVLKADFDNKLVNGPKSESMEYSSCAHEEEQRLELNSCPLENVTKNEESMTGIEVENWTQNKKSHLTDHVKGEFSTVKTEVENLKNSEDDRKKILLTDLLEPQKLFAQTVRNGIKNVHYLPTETNLSFKKINIEELGKAFESNPYKFLKDTANHNNVMSTIATSGSCDHLKGKSNVLVIQKPGFNCKSFPDPVNCNSNSHTSIHNESDQPKSLEIIANRDLKEGSTLQPSLLSLMKDRRLTLEQVVAIEALTQLSEAPSENSSPSKSEKDEETEQRTASLLNSCKAILYSVRKDLQDPNLKGEPQSLHHCPSLEKQSSCNAVVFNGQNIISKSHNSSPSDQASTKAQESSTVTNSISLLIPNSNSSKTDTNKNIAQGRITLDSSRSLQPLTTITSKSEYCNQSLDNSIKLDSKDDSSCQDSVHSKIEEDVAAQLTQLASMIKFNYVKPEDKKVESTPISLVAYNVQQKYNQEMGTPPQKPPSNVQNNQGSSVTKQKNTIQKKTKATPSRDRRKKKHMVISCQENDQKKQEQLSYEYSKLHDIWIASKFQRFGQFGPHDFPILLGKIPPLTKVWKPLTQTSSALEHKKLFPPLAQIKFERYYPELAQEKMKVEPLDSIPIIQLKTESNGQAFTENAYTQVQPTVNVNQKAHPLLQPASPTNQCANVLDGSDQRQFQEDVKDQLMHQRLPTSPGISHETPLPDPAQILRNLNVVCSGGITVVSTKNEEDVCSSSVGTSEFPPINSAQKTFNDYAMNFFTNSTKTLVSTTKDSELPTCNCLDRVIQKDKGPYYTHLGAGPSVAAVREIMENRYGQKGNAIRIEIVVYTGKEGKSSNGCPVAKWVLRRSSDEEKVLCLVRQRTGHHCPTAVMVVLIMVWDGIPLPMADKLYSQLTESLKSYNGHPTDRRCTLNENRTCTCQGIDPETCGASFSFGCSWSMYFNGCKFGRSPSPRRFRIDPSSPLHHYYERITKGRNPERRYMKPEPICPEHEAMEKNLEDNLQSLATELAPIYKQYAPAAYQNQVALEHIARECRLGKKEGRPFSGVTACLDFCAHPHRDIHNMNNGSTVVCTLTREDNRSFGVIPQDEQLHVLPLYKLSDTDEFGSREGMEAKIKSGAIMVLAPRQKKRMRFTQPVPRSGKKRAAMMTEVLAHKIRAVEKKFIPRIKRKNNSMTNNSKASSLPLLGNKTETVQPEIKSETEPHLIFKGSDNTKSYSPAPFIPHPVKEENLAPAFSWSSKTALVTTAPFKNDASLSYGFSERGSNPHCIMPSARHSGANVAAGECSEIAQPGEMVPLPTLSTPMTNSLGYSEPPIGPSEQLTSNQPNQQPPFITSPHELASSLVEEDEQPSEADEPPSDDPLSDDPLSPAEEKLPHIVEYWSDSEHIFLDANVGGVAIAPSHGSVLIECARRELHATTPVDHPNRNHPTRLSLVFYQHKNLNKPQHGFELNKIKFEAKEAKNKKTKASEQKDQAANEGIELTEVNEFSQIPSHKALTLTHDNVVTVSPYALTHVAGPYNHWV

SEQ ID NO: 8 - protein, 718 aa, Homo sapiens
LPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 9 - protein, 718 aa, Pan paniscus
LPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPCRKKRTCFTQPVPRSGKKRAAMMTEVLAHKIRAVEKKPIPRIKRKNNSTTTNNSKASSLPTLGSKTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 10 - protein, 718 aa, Gorilla gorilla gorilla
LPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSREGMEAKIKSGAIEVLAPCRKKRTCFTQPVPRSGKKRAAMMTEVLAHKIRAVEKKPIPRIKRKNNSTTTNNSKASSLPTLGSKTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLVNSEPSTGVTEPLTPHQPNHQPSFLTSPQDLASSPMEEDEQHSEADEPPSDEPLSDDLLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 11 - protein, 718 aa, Mandrillus leucophaeus
LPTCNCLDRVIQKDKGPYYTHLGAGPSVAAVREIMENRYGEKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRVKRKNNSTTTNNSKASPLPALGSKTETVQPEVKSETEPHFILKSSDNTKTYSLMPSAPHPVKEASPVFSWSPKTASATPAPLKNDAAASCGFSERSSTPHCTMSSGRLSGANAAAVEGPGISQLGEAAPLPTLSAPVMEPLVNSEPPTGVTEPLTSHQPNHQPSFLTSPQDLDSSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPELSSEVNELNQIPSHKALTLTHDNVVTVSPYALTHVAGPYNHWV

SEQ ID NO: 12 - protein, 719 aa, Equus caballus
LPTCNCLDRVIQKDKGPYYTHLGAGPSVAAVREIMENRYGQKGNAVRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYEHVARECRLGSKEGRPFSGVTACLDFCAHPHRDIHNMNNGSTVVCTLTREDNRSLGVIPQDEQLHVLPLYKLSDTDEFGSREGMEAKIKSGAIEVLTPRRKKRTRFTQPVPRSGKKRAAMMTEVLAHKIRAVEKKFIPRIKRKNNSMTNSSKTSSLPLLGSKTETLQPEIKSETEPHFIVKDLDNTKTYSLTPSIPHPVKEANLSPGFPWSCNTASATTVPFKDGASDPYGFSERGSNPHCTMPSARHSGANAAAGECTGSAQPGEVVPLPTLSTPVTDSLVYSEPPTGPSEQLTSNQPNQQPPFITSPHELASSLVEEDEQHSEVDEPLSDDPLSDDALSPAEEKLPHIDEYWSDSEHIFLDANIGGVAIAPAHGSVLIECARRELHATTPVENPNRNHPTRLSLVFYQHKNLNKPQHGFELNKIKFEAKEAKNKKIKASEQKDQAANEGPELCPEVNELNQIPSHKALTLTHDNVVTVSPYALTHVAGPYNHWV

SEQ ID NO: 13 - protein, 718 aa, Canis lupus familiaris
LPTCNCLDRVIQKDKGPYYTHLGAGPSVAAVREIMENRYGQKGNAIRIEIVVYTGKEGKSSHGCPIAKWVLRRGSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYEHVARECRLGSKEGRPFSGVTACLDFCAHPHRDIHNMNNGSTVVCTLTREDNRSLGVIPQDEQLHVLPLYKLSDTDEFGSREGMEAKIKSGAIEVLTPRRKKRKRFTQPVPRSGKKRAAMMTEVLAHKIRAVEKKFVPRVKRKNNSTSNGKTSSLPLLGNKTEALQLEIKSETEPHFIFKGSDNTKTYSLTPSIPHTLKEANISPGFSWSPKTTSATTAPFKNDVSVSYGFSERSSNPHCTMPSARHSGANAAAGECTGIAQPGEVVALSTLSTPVTESLVYSEPSTGPSEQLPSNHPNQQAPFTTSPHDLTSSLVEEDEQHSDADEPLSDDPLSDDPLSPTEEKLPHIDEYWSDSEHIFLDANIGGVAIAPAHGSVLIECARRELHATTPVEHPNRNHPTRLSLVFYQHKNLNKPQHGFELNKIKFEAKEAKNKKIKASEQKDQAANEVPDLSPEVNELNQIPSHKALTLTHDNIVTVSPYALTHVAGPYNHWV

SEQ ID NO: 14 - protein, 747 aa, Ovis aries
LPTCNCLDRVIQKDKGPYYTHLGAGPSVAAVREIMENRYGQKGNAIRIEIVVYTGKEGKSSNGCPVAKWVLRRSSDEEKVLCLVRQRTGHHCPTAVMVVLIMVWDGIPLPMADKLYSQLTESLKSYNGHPTDRRCTLNENRTCTCQGIDPETCGASFSFGCSWSMYFNGCKFGRSPSPRRFRIDPSSPLHHYYERITKGRNPERRYMKPEPICPEHEAMEKNLEDNLQSLATELAPIYKQYAPAAYQNQVALEHIARECRLGKKEGRPFSGVTACLDFCAHPHRDIHNMNNGSTVVCTLTREDNRSFGVIPQDEQLHVLPLYKLSDTDEFGSREGMEAKIKSGAIMVLAPRQKKRMRFTQPVPRSGKKRAAMMTEVLAHKIRAVEKKFIPRIKRKNNSMTNNSKASSLPLLGNKTETVQPEIKSETEPHLIFKGSDNTKSYSPAPFIPHPVKEENLAPAFSWSSKTALVTTAPFKNDASLSYGFSERGSNPHCIMPSARHSGANVAAGECSEIAQPGEMVPLPTLSTPMTNSLGYSEPPIGPSEQLTSNQPNQQPPFITSPHELASSLVEEDEQPSEADEPPSDDPLSDDPLSPAEEKLPHIVEYWSDSEHIFLDANVGGVAIAPSHGSVLIECARRELHATTPVDHPNRNHPTRLSLVFYQHKNLNKPQHGFELNKIKFEAKEAKNKKTKASEQKDQAANEGIELTEVNEFSQIPSHKALTLTHDNVVTVSPYALTHVAGPYNHWV

SEQ ID NO: 15 - protein, 1390 aa, Artificial Sequence
  Synthetic Construct
MPKKKRKVGRGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVAAIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 16 - protein, 1139 aa, Artificial Sequence
  Synthetic Construct
MPKKKRKVSDLVLGLAIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVAAILPLSITFDDSLANKVLVYATAAQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINDKGKEVPCNPFLKYKEEHGYIRKYSKKGNGPEIKSLKYYDSKLGNHIDITPKDSNNKVVLQSVSPWRADVYFNKTTGKYEILGLKYADLQFDKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFSRADPKKKRKV

SEQ ID NO: 17 - protein, 1100 aa, Artificial Sequence
  Synthetic Construct
MPKKKRKVAAFKPNPINYILGLAIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIAAALPFSRTWDDSFNNKVLVLGSEAQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVRSRADPKKKRKV

SEQ ID NO: 18 - DNA, 102 bp, Artificial Sequence
  Synthetic Construct
  misc_feature 1, 2, 3, 4, 5, 6, 7, 8, 9, 10, 11, 12, 13, 14, 15, 16, 17,18, 19, 20: n = A,T,C or G
nnnnnnnnnnnnnnnnnnnngttttagagctagaaatagcaagttaaaataaggctagtccgttatcaacttgaaaaagtggcaccgagtcggtgctttttt

SEQ ID NO: 19 - DNA, 110 bp, Artificial Sequence
  Synthetic Construct
  misc_feature 1, 2, 3, 4, 5, 6, 7, 8, 9, 10, 11, 12, 13, 14, 15, 16, 17,18, 19, 20: n = A,T,C or G
nnnnnnnnnnnnnnnnnnnngtttttgtactctcagaaatgcagaagctacaaagataaggcttcatgccgaaatcaacaccctgtcattttatggcagggtgttttttt

SEQ ID NO: 20 - DNA, 128 bp, Artificial Sequence
  Synthetic Construct
  misc_feature 1, 2, 3, 4, 5, 6, 7, 8, 9, 10, 11, 12, 13, 14, 15, 16, 17,18, 19, 20: n = A,T,C or G
nnnnnnnnnnnnnnnnnnnngttgtagctccctttctcgaaagagaaccgttgctacaataaggccgtctgaaaagatgtgccgcaacgctctgccccttaaagcttctgctttaacgggcttttttt

SEQ ID NO: 21 - DNA, 5787 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagacgcgtccatggttgggtaccaacaaatggctggtggacttaacgatatcttcgaagctcagaagattgaatggcatgaggatactggtggatctagcatccccggacttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgaggactacaaagacgatgacgacaaagactacaaagacgatgacgacaaagactacaaagacgatgacgacaaaaagcttgatatcgccatggggggcgcgccaagctatcaaacaagtttgtacaaaaaagcaggctccgcggccgcccccttcaccatgggatccctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaagggtgggcgcgccgacccagctttcttgtacaaagtggttcgataattccttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 22 - DNA, 1992 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagacgcgt

SEQ ID NO: 23 - DNA, 630 bp, Artificial Sequence
  Synthetic Construct
ccatggttgggtaccaacaaatggctggtggacttaacgatatcttcgaagctcagaagattgaatggcatgaggatactggtggatctagcatccccggacttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggac

SEQ ID NO: 24 - DNA, 97 bp, Artificial Sequence
  Synthetic Construct
tcgaggactacaaagacgatgacgacaaagactacaaagacgatgacgacaaagactacaaagacgatgacgacaaaaagcttgatatcgccatggg

SEQ ID NO: 25 - DNA, 2166 bp, Artificial Sequence
  Synthetic Construct
atgggatccctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctga

SEQ ID NO: 26 - DNA, 739 bp, Artificial Sequence
  Synthetic Construct
ctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacg

SEQ ID NO: 27 - protein, 984 aa, Artificial Sequence
  Synthetic Construct
MVGYQQMAGGLNDIFEAQKIEWHEDTGGSSIPGLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEDYKDDDDKDYKDDDDKDYKDDDDKKLDIAMGGAPSYQTSLYKKAGSAAAPFTMGSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 28 - protein, 169 aa, Artificial Sequence
  Synthetic Construct
LEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGL

SEQ ID NO: 29 - protein, 27 aa, Artificial Sequence
  Synthetic Construct
DYKDDDDKDYKDDDDKDYKDDDDKKLD

SEQ ID NO: 30 - protein, 718 aa, Artificial Sequence; identical to SEQ ID NO: 8
  Synthetic Construct

SEQ ID NO: 31 - DNA, 9415 bp, Artificial Sequence
  Synthetic Construct
ggcgcgccatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgccggcgcgccaagctatcaaacaagtttgtacaaaaaagcaggctccgcggccgcccccttcaccatgcgtacgtatccctatgacgtgcccgattatgccagcctgggcagcggcgctcccaagaaaaaacgcaaggtggaagctcctaagaaaaagcggaaagtgggcggtggcggatccgggctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgacgtacgaagggtgggcgcgccgacccagctttcttgtacaaagtggttcgataattccttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 32 - DNA, 1995 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacag

SEQ ID NO: 33 - DNA, 115 bp, Artificial Sequence
  Synthetic Construct
ggatcatcaacaagtttgtacaaaaaagcaggctctttaaagtatttttacaacaattaccaacaacaacaaacaacaaacaacattacaattactatttacaattacaaaaaaa

SEQ ID NO: 34 - DNA, 4107 bp, Artificial Sequence
  Synthetic Construct
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcc

SEQ ID NO: 35 - DNA, 27 bp, Artificial Sequence
  Synthetic Construct
tatccctatgacgtgcccgattatgcc

SEQ ID NO: 36 - DNA, 48 bp, Artificial Sequence
  Synthetic Construct
cccaagaaaaaacgcaaggtggaagctcctaagaaaaagcggaaagtg

SEQ ID NO: 37 - DNA, 18 bp, Artificial Sequence
  Synthetic Construct
ggcggtggcggatccggg

SEQ ID NO: 38 - DNA, 2157 bp, Artificial Sequence
  Synthetic Construct
ctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctga

SEQ ID NO: 39 - DNA, 744 bp, Artificial Sequence
  Synthetic Construct
cctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 40 - protein, 2148 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAGAPSYQTSLYKKAGSAAAPFTMRTYPYDVPDYASLGSGAPKKKRKVEAPKKKRKVGGGGSGLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 41 - protein, 1369 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDA

SEQ ID NO: 42 - protein, 9 aa, Artificial Sequence
  Synthetic Construct
YPYDVPDYA

SEQ ID NO: 43 - protein, 16 aa, Artificial Sequence
  Synthetic Construct
PKKKRKVEAPKKKRKV

SEQ ID NO: 44 - protein, 6 aa, Artificial Sequence
  Synthetic Construct
GGGGSG

SEQ ID NO: 45 - protein, 718 aa, Artificial Sequence; identical to SEQ ID NO: 8
  Synthetic Construct

SEQ ID NO: 46 - DNA, 793 bp, Artificial Sequence
  Synthetic Construct
ggccgcaatattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgaacaaagcaccagtggtctagtggtagaatagtaccctgccacggtacagacccgggttcgattcccggctggtgcagacggaaagatgtatgggcttgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaaaactaggccatccatggagtttaaacaaacaaactttttttaaaccaccccgtgtcaacgcggc

SEQ ID NO: 47 - DNA, 473 bp, Artificial Sequence
  Synthetic Construct
ggccgcaatattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattg

SEQ ID NO: 48 - DNA, 77 bp, Artificial Sequence
  Synthetic Construct
aacaaagcaccagtggtctagtggtagaatagtaccctgccacggtacagacccgggttcgattcccggctggtgca

SEQ ID NO: 49 - DNA, 76 bp, Artificial Sequence
  Synthetic Construct
gttttagagctagaaatagcaagttaaaataaggctagtccgttatcaacttgaaaaagtggcaccgagtcggtgc

SEQ ID NO: 50 - DNA, 7 bp, Artificial Sequence
  Synthetic Construct
ttttttt

SEQ ID NO: 51 - DNA, 1223 bp, Artificial Sequence
  Synthetic Construct
ggccgcaatattacaacttgtttaagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgaacaaagcaccagtggtctagtggtagaatagtaccctgccacggtacagacccgggttcgattcccggctggtgcagcggcgcaagatctgatattgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaccattggtccaagtgctattgttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaattctcgacggaaagatgtagttttagagctagaaatagcaagttaaaataaggctagtccgttatcaacttgaaaaagtggcaccgagtcggtgcgtttaacaaagcaccagtggtctagtggtagaatagtaccctgccacggtacagacccgggttcgattcccggctggtgcaaaaactaggccatccatggagttttagagctagaaatagcaagttaaaataaggctagtccgttatcaacttgaaaaagtggcaccgagtcggtgcgtttaaacaaacaaactttttttaaaccaccccgtgtcaacgcggc

SEQ ID NO: 52 - protein, 130 aa, Artificial Sequence
  Synthetic Construct
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIY

SEQ ID NO: 53 - protein, 247 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSS

SEQ ID NO: 54 - DNA, 15526 bp, Artificial Sequence
  Synthetic Construct
  misc_feature 157, 158, 159, 160, 161, 162, 163, 164, 165, 166, 167, 168,169, 170, 171, 172, 173, 174, 175, 176: n = A,T,C or G
ggtttcagaattcaaaaaaagcaccgactcggtgccacttggccctgcagacatgggtgatcctcatgttggccaagttgataacggactagccttattttaacttgctaggccctgcagacatgggtgatcctcatgttggcctagctctaaaacnnnnnnnnnnnnnnnnnnnncaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacctcgtcgcaaaattcgccctggacccgcccaacgatttgtcgtcactgtcaaggtttgacctgcacttcatttggggcccacatacaccaaaaaaatgctgcataattctcggggcagcaagtcggttacccggccgccgtgctggaccgggttgaatggtgcccgtaactttcggtagagcggacggccaatactcaacttcaaggaatctcacccatgcgcgccggcggggaaccggagttcccttcagtgagcgttattagttcgccgctcggtgtgtcgtagatactagcccctggggcacttttgaaatttgaataagatttatgtaatcagtcttttaggtttgaccggttctgccgctttttttaaaattggatttgtaataataaaacgcaattgtttgttattgtggcgctctatcatagatgtcgctataaacctattcagcacaatatattgttttcattttaatattgtacatataagtagtagggtacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcaggactctagggactagtcccgggtcttaattaactctctagactcacctaggagctccaccgcggtggcggccgctctagaactagttaattaagaattatcgaaccactttgtacaagaaagctgggcccatgaggccattaatcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagggatccggttatatctccttctggccttgacggcccttcagcttttttgtacaaacttgtttgatagcttggcgcgcccttgtcatcgtcatccttgtagtctttatcgtcatcgtctttataatccgccaccttcctctttttcttaggtccgctacctcctcctccgcttcctcctcctccgcttccacctcctccagcgctgtagatacctgagttagcggcgatggcggaagggataggattaccgtctttgaggagcccctgcattgccttcacgatgagttcacagtcagaattggtagcgaaaattgggatagtgagctccatgttcaggtaggacctccaagcggcgacaggcagttcgactccgcccactgtctgggtagccactttggggacctccaccttgatggtatactttctcttctgggcactagactgcctgacgctgcatgtcaccttgtaggcctggctccgtgagttggagctgatccactctgccaccccattagcgaaattagaaggagccactgtcacatcccctgtcccaccattgtccacgagcacgaactgagtaaagtttgaagccatctgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactacgcaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggc

SEQ ID NO: 55 - DNA, 163 bp, Artificial Sequence
  Synthetic Construct
  misc_feature 144, 145, 146, 147, 148, 149, 150, 151, 152, 153, 154, 155,156, 157, 158, 159, 160, 161, 162, 163: n = A,T,C or G
aaaaaaagcaccgactcggtgccacttggccctgcagacatgggtgatcctcatgttggccaagttgataacggactagccttattttaacttgctaggccctgcagacatgggtgatcctcatgttggcctagctctaaaacnnnnnnnnnnnnnnnnnnnn

SEQ ID NO: 56 - DNA, 450 bp, Artificial Sequence
  Synthetic Construct
caatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagctt

SEQ ID NO: 57 - DNA, 746 bp, Artificial Sequence
  Synthetic Construct
aaacctcgtcgcaaaattcgccctggacccgcccaacgatttgtcgtcactgtcaaggtttgacctgcacttcatttggggcccacatacaccaaaaaaatgctgcataattctcggggcagcaagtcggttacccggccgccgtgctggaccgggttgaatggtgcccgtaactttcggtagagcggacggccaatactcaacttcaaggaatctcacccatgcgcgccggcggggaaccggagttcccttcagtgagcgttattagttcgccgctcggtgtgtcgtagatactagcccctggggcacttttgaaatttgaataagatttatgtaatcagtcttttaggtttgaccggttctgccgctttttttaaaattggatttgtaataataaaacgcaattgtttgttattgtggcgctctatcatagatgtcgctataaacctattcagcacaatatattgttttcattttaatattgtacatataagtagtagggtacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcaggactctagggactagtcccgggtcttaattaactctctagactcacctagg

SEQ ID NO: 58 - DNA, 2168 bp, Artificial Sequence
  Synthetic Construct
attaatcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagggatcc

SEQ ID NO: 59 - DNA, 48 bp, Artificial Sequence
  Synthetic Construct
cttgtcatcgtcatccttgtagtctttatcgtcatcgtctttataatc

SEQ ID NO: 60 - DNA, 21 bp, Artificial Sequence
  Synthetic Construct
caccttcctctttttcttagg

SEQ ID NO: 61 - DNA, 45 bp, Artificial Sequence
  Synthetic Construct
gctacctcctcctccgcttcctcctcctccgcttccacctcctcc

SEQ ID NO: 62 - DNA, 390 bp, Artificial Sequence
  Synthetic Construct
gtagatacctgagttagcggcgatggcggaagggataggattaccgtctttgaggagcccctgcattgccttcacgatgagttcacagtcagaattggtagcgaaaattgggatagtgagctccatgttcaggtaggacctccaagcggcgacaggcagttcgactccgcccactgtctgggtagccactttggggacctccaccttgatggtatactttctcttctgggcactagactgcctgacgctgcatgtcaccttgtaggcctggctccgtgagttggagctgatccactctgccaccccattagcgaaattagaaggagccactgtcacatcccctgtcccaccattgtccacgagcacgaactgagtaaagtttgaagccat

SEQ ID NO: 63 - DNA, 1990 bp, Artificial Sequence
  Synthetic Construct
ctgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactacgc

SEQ ID NO: 64 - DNA, 2022 bp, Artificial Sequence
  Synthetic Construct
aaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaa

SEQ ID NO: 65 - DNA, 1986 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacag

SEQ ID NO: 66 - DNA, 115 bp, Artificial Sequence; identical to SEQ ID NO: 33
  Synthetic Construct

SEQ ID NO: 67 - DNA, 4401 bp, Artificial Sequence
  Synthetic Construct
atggacaaaaaatacagcattgggttggccattgggacaaatagcgtgggttgggcagtcattacagacgaatacaaggttcctagcaagaagttcaaggtgttgggcaacactgacaggcactcgatcaagaaaaatctcattggtgcactccttttcgatagtggggagactgccgaagcgaccagactgaaaaggactgctagaaggcgctatacccggcgtaagaatcgcatttgctacctccaggagatattctctaacgaaatggccaaggttgatgacagcttctttcatcgcttggaggaatcattcctcgtcgaggaagacaagaaacacgagcggcatccgatctttggaaacattgttgatgaggtcgcatatcacgaaaagtaccccacgatctaccatcttcgcaagaaactggtggattcaactgacaaggctgatctgcggttgatatacctcgcacttgctcacatgatcaagttccgtggccattttcttattgagggagacctgaaccctgataattctgacgtcgataagttgttcatccagctcgtgcaaacatacaatcagctctttgaggaaaaccctatcaacgcctctggagttgatgccaaagcgatcctttccgcgaggctgtcgaagagtagaaggctggagaacttgatcgcccaacttcctggcgaaaagaaaaacggtttgttcgggaatctcattgcgctgagcttgggactcacgccaaacttcaagtctaacttcgacctcgcagaggatgctaaacttcagctgtccaaggatacttatgatgacgatcttgacaacctgttggcacaaatcggtgaccagtacgctgatttgttcctcgctgccaagaacctcagcgatgccatactcctttcagacatcctccgcgtgaacactgagattaccaaagcacctctgtctgcttccatgataaagcgttatgatgagcaccatcaagacctcactctgttgaaggcgttggttagacagcaactcccagagaagtacaaagaaatcttctttgaccaatctaagaatggctacgccggatatattgatggcggagcgtcccaggaggagttctacaagtttatcaaacctattcttgagaagatggatggtacggaggaactccttgttaaactgaatagagaggatctcttgcgcaagcaacggactttcgacaacggcagcataccgcaccagatccatctcggagagcttcacgccatccttcgccggcaggaagatttctacccctttctgaaggacaaccgtgagaagatcgaaaaaatccttactttcagaatcccttactatgtcggtccactggctagaggcaactctagatttgcttggatgacacgcaagagtgaggaaactatcaccccttggaacttcgaggaagtggttgacaagggcgcatcggctcaaagtttcattgagagaatgactaattttgataagaaccttccgaacgagaaagtcctgcccaagcattcactcctttacgagtatttcacagtgtataacgaacttacgaaggtgaaatacgttactgagggtatgcggaagccggcattcctgtcgggggaacaaaagaaagctatagtggatctgttgtttaaaactaacaggaaggttaccgtcaagcagcttaaggaggattacttcaagaaaatagaatgttttgactcggtggagatcagtggcgttgaagatagattcaacgcttcactgggaacctaccacgacctccttaagatcattaaggacaaagatttcttggataacgaggaaaatgaggacattctcgaagatatagtccttacactgacgttgtttgaggaccgtgaaatgatcgaggaaagattgaagacctatgctcatctcttcgacgataaggttatgaagcagctcaagcgtagaaggtacacaggttgggggcgtctttctagaaagctgattaatggcataagggataaacaatctggaaagacgattctggatttcctcaagtccgacggcttcgccaaccgcaattttatgcagcttatacacgacgattccctgactttcaaagaggacatccagaaggcccaagttagcggccaaggagattcacttcacgagcatatcgccaacctggcgggtagcccggcgatcaagaaagggattcttcagaccgtcaaggtcgtggatgagctggtgaaagttatgggccggcataagcccgaaaacatagtgatcgagatggcccgtgaaaatcagactacccaaaaaggacagaagaactcccgcgagcggatgaaaaggatagaggaaggcatcaaggaacttggaagccagatcctgaaggagcacccagttgaaaacacacagttgcaaaatgagaagctctatctttactatctccaaaatggtagagacatgtatgtggatcaggagttggacattaacaggctctcagactacgatgtcgacgctatcgtgccgcaatcgttccttaaggacgatagtatagataataaggtgctgactcggtcggataaaaaccgtggcaagtcggacaatgttcccagtgaggaagttgtgaagaagatgaagaactactggcgccaactgttgaatgcaaaattgatcacccagaggaagtttgacaacctcacaaaagcagagcgcggtgggctcagtgaacttgataaagctggattcattaagaggcaacttgttgagacacgccagattacgaagcacgtcgcgcagatactggattctaggatgaacaccaagtacgacgagaatgataaattgatcagagaagtgaaggttatcacattgaagtctaaactcgtgtccgattttcgcaaagacttccaattttataaggttcgggagatcaacaattatcaccatgcacatgatgcttacctcaacgccgtggttggtacggcgttgattaagaaatacccgaagctggagtctgagttcgtgtacggggattataaggtctacgacgtgaggaaaatgatcgctaagagtgagcaggaaattggtaaagccaccgcgaagtatttcttttactctaacatcatgaacttcttcaagacagagataacgttggcaaatggtgaaatacgtaagagacctctcatcgagactaacggtgaaaccggggaaatcgtttgggataaagggcgggactttgctactgttcgtaaggtcctctccatgccgcaagtgaatattgttaagaaaacagaggtccagacgggcggattctctaaggaatccatccttcccaaaagaaacagcgacaagctgattgcgaggaagaaagattgggaccctaagaaatatggtgggttcgattctccaaccgttgcctactccgtcttggtcgtggcgaaggttgagaagggtaaatctaagaaactcaaatccgtcaaggaactccttgggattactatcatggagaggtcttccttcgaaaagaatcctatcgatttccttgaggctaaaggctataaggaagtgaagaaggatctcatcatcaagctcccaaagtacagcctgtttgagttggaaaacggaaggaagcgcatgttggcatcagctggagagctccagaaagggaacgagctggccttgccttctaagtatgtgaacttcctctatcttgcgtcgcactacgagaagctgaaaggcagtccagaggacaacgaacagaaacaactttttgttgagcaacacaagcattatctggatgagattatagaacagatcagcgagttctcaaaaagagtcattcttgccgatgctaacctcgacaaggtgctctccgcatacaacaaacacagagacaagccgatcagggagcaggctgaaaatatcattcatctcttcactcttaccaacctgggtgcccccgcggcattcaagtattttgatacaacgattgaccggaaacgttacacaagcacgaaggaggtccttgatgcgaccctgattcatcaaagcataacagggctctatgagacgagaatcgatttgtcacagctcggcggagactacccgtatgacgtgcccgattacgctgccgcggcagctgagttcaagcgcgaggaacaggcccggaaggcgaaagtgaacaatgagaagaaaacagaaatcgttaaacctgagagctgctcaaacgagggagacgttaaggatcttaagaggaaagactctgaggatggcaacgaaggagaggaagaggaagctagctcaaaacctaagaaaccaaaggtggcactctcacatctccaagacattgacgacaccgaagcagaccaagaagaagaacccgggggcgcgccatgataa

SEQ ID NO: 68 - DNA, 774 bp, Artificial Sequence
  Synthetic Construct
ctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggc

SEQ ID NO: 69 - protein, 1465 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDYPYDVPDYAAAAAEFKREEQARKAKVNNEKKTEIVKPESCSNEGDVKDLKRKDSEDGNEGEEEEASSKPKKPKVALSHLQDIDDTEADQEEEPGGAP

SEQ ID NO: 70 - protein, 1368 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 71 - protein, 7 aa, Artificial Sequence
  Synthetic Construct
YPYDVPD

SEQ ID NO: 72 - protein, 90 aa, Artificial Sequence
  Synthetic Construct
YAAAAAEFKREEQARKAKVNNEKKTEIVKPESCSNEGDVKDLKRKDSEDGNEGEEEEASSKPKKPKVALSHLQDIDDTEADQEEEPGGAP

SEQ ID NO: 73 - protein, 908 aa, Artificial Sequence
  Synthetic Construct
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSAGGGGSGGGGSGGGGSGPKKKRKVADYKDDDDKDYKDDDDKGAPSYQTSLYKKAEGPSRPEGDITGSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHV

SEQ ID NO: 74 - protein, 132 aa, Artificial Sequence
  Synthetic Construct
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSA

SEQ ID NO: 75 - protein, 15 aa, Artificial Sequence
  Synthetic Construct
GGGGSGGGGSGGGGS

SEQ ID NO: 76 - protein, 9 aa, Artificial Sequence
  Synthetic Construct
GPKKKRKVA

SEQ ID NO: 77 - protein, 17 aa, Artificial Sequence
  Synthetic Construct
DYKDDDDKDYKDDDDKG

SEQ ID NO: 78 - protein, 712 aa, Artificial Sequence
  Synthetic Construct
GSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHV

SEQ ID NO: 79 - DNA, 16237 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccaacggtccgactgacgccgcggaagaggagcttctgagcaaaaactatcacctcgaaaacgaggttgcgcgactgaagaaaggaagcgggtccggtggaagtggctccggatctggaggttctggcagcggaggtagcggcagtggcgaagagctccttagtaagaactatcatctggaaaatgaggtagcgcgcttaaagaaagggtcgggaagtggcggcagcggaagtgggagtggagggagcggttctggcggttccggcagtggagaggagttgctgtctaagaactaccacttagaaaacgaagtcgcacggctaaaaaaaggttccggctccggcggctccggttctggaagcgggggctcgggatcaggtggatctggatcaggagaggaattgctttccaaaaactaccaccttgagaatgaggtggccaggttaaagaaggggagcggctcggggggtagtggatcggggtcgggcgggtcaggaagcggtggtagcggatctggggaggagctgctctcgaagaattaccatttggagaacgaagtggcgagactaaagaagggaagcggtagtggtggttcagggtctggttcaggtggcagtgggtctgggggctcagggtccgggtagcccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatctgcggccgcttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggatcccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaacttgtttcctaggatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacacctagggtttatgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccggtcgtacgtatccctatgacgtgcccgattatgccagcctgggcagcggcgctcccaagaaaaaacgcaaggtggaagctcctaagaaaaagcggaaagtgggcggtggcggatccgggctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgacgtacgggaggaggatctcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggtggtagcggtggtggtactagtccaaaaacaaggaggagaccgcgaagatcacaacggaaaaggccgcctacgccatggccgtaagtttgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttac

SEQ ID NO: 80 - DNA, 563 bp, Artificial Sequence
  Synthetic Construct
  misc_feature 451, 452, 453, 454, 455, 456, 457, 458, 459, 460, 461, 462,463, 464, 465, 466, 467, 468, 469, 470: n = A,T,C or G
cttaagtcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgnnnnnnnnnnnnnnnnnnnngttttagagctagaaatagcaagttaaaataaggctagtccgttatcaacttgaaaaagtggcaccgagtcggtgctttttttgtttcttaag

SEQ ID NO: 81 - DNA, 1994 bp, Artificial Sequence
  Synthetic Construct
atgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaaca

SEQ ID NO: 82 - DNA, 115 bp, Artificial Sequence; identical to SEQ ID NO: 33
  Synthetic Construct

SEQ ID NO: 83 - DNA, 4107 bp, Artificial Sequence; identical to SEQ ID NO: 34
  Synthetic Construct

SEQ ID NO: 84 - DNA, 27 bp, Artificial Sequence
  Synthetic Construct
tatccctatgacgtgcccgattatgcc

SEQ ID NO: 85 - DNA, 47 bp, Artificial Sequence
  Synthetic Construct
ccaagaaaaaacgcaaggtggaagatcctaagaaaaagcggaaagtg

SEQ ID NO: 86 - DNA, 60 bp, Artificial Sequence
  Synthetic Construct
gacggcattggtagtgggagcaacggcagcagcggatccaacggtccgactgacgccgcg

SEQ ID NO: 87 - DNA, 621 bp, Artificial Sequence
  Synthetic Construct
gaagaggagcttctgagcaaaaactatcacctcgaaaacgaggttgcgcgactgaagaaaggaagcgggtccggtggaagtggctccggatctggaggttctggcagcggaggtagcggcagtggcgaagagctccttagtaagaactatcatctggaaaatgaggtagcgcgcttaaagaaagggtcgggaagtggcggcagcggaagtgggagtggagggagcggttctggcggttccggcagtggagaggagttgctgtctaagaactaccacttagaaaacgaagtcgcacggctaaaaaaaggttccggctccggcggctccggttctggaagcgggggctcgggatcaggtggatctggatcaggagaggaattgctttccaaaaactaccaccttgagaatgaggtggccaggttaaagaaggggagcggctcggggggtagtggatcggggtcgggcgggtcaggaagcggtggtagcggatctggggaggagctgctctcgaagaattaccatttggagaacgaagtggcgagactaaagaagggaagcggtagtggtggttcagggtctggttcaggtggcagtgggtctgggggctcagggtccgggtag

SEQ ID NO: 88 - DNA, 768 bp, Artificial Sequence
  Synthetic Construct
tagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccggcatgcaagctagcttactagtgatattctatagtgtcacctaaatct

SEQ ID NO: 89 - DNA, 2018 bp, Artificial Sequence
  Synthetic Construct
ttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggatcccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaactt

SEQ ID NO: 90 - DNA, 831 bp, Artificial Sequence
  Synthetic Construct
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagc

SEQ ID NO: 91 - DNA, 711 bp, Artificial Sequence
  Synthetic Construct
agcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaa

SEQ ID NO: 92 - DNA, 2157 bp, Artificial Sequence; identical to SEQ ID NO: 38
  Synthetic Construct

SEQ ID NO: 93 - DNA, 263 bp, Artificial Sequence
  Synthetic Construct
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttac

SEQ ID NO: 94 - protein, 1626 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVDGIGSGSNGSSGSNGPTDAAEEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSG

SEQ ID NO: 95 - protein, 1369 aa, Artificial Sequence; identical to SEQ ID NO: 41
  Synthetic Construct

SEQ ID NO: 96 - protein, 9 aa, Artificial Sequence
  Synthetic Construct
YPYDVPDYA

SEQ ID NO: 97 - protein, 16 aa, Artificial Sequence
  Synthetic Construct
PKKKRKVEDPKKKRKV

SEQ ID NO: 98 - protein, 20 aa, Artificial Sequence
  Synthetic Construct
DGIGSGSNGSSGSNGPTDAA

SEQ ID NO: 99 - protein, 206 aa, Artificial Sequence
  Synthetic Construct
EEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSG

SEQ ID NO: 100 - protein, 1286 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGSLDPGGGGSGSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKGGGRTGRTYPYDVPDYASLGSGAPKKKRKVEAPKKKRKVGGGGSGLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 101 - protein, 277 aa, Artificial Sequence
  Synthetic Construct
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 102 - protein, 237 aa, Artificial Sequence
  Synthetic Construct
SKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYK

SEQ ID NO: 103 - protein, 718 aa, Artificial Sequence; identical to SEQ ID NO: 8
  Synthetic Construct

SEQ ID NO: 104 - protein, 411 aa, Artificial Sequence
  Synthetic Construct
EEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSG

SEQ ID NO: 105 - DNA, 17065 bp, Artificial Sequence
  Synthetic Construct
aaaaaaagcaccgactcggtgccactttttcaagttgataacggactagccttattttaacttgctatttctagctctaaaacaagcccatacatctttccgtcaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacgtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaacttacggccatggcgtaggcggccttttccgttgtgatcttcgcggtctcctccttgtttttggactagtaccaccaccgctaccaccaccttcggttaccgtgaaggttttggtagcgtcgtcgtaggtccattcaccgtcaacaccgttgtcgttagcgtactgtttgaaaactttttccgcggtagcagcgtcaacagcttcggtggtggtttcacctttcagggttttaccgttcaggataagcttgtactcttcggtccgagatcctcctcccgtacgtcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagcccggatccgccaccgcccactttccgctttttcttaggagcttccaccttgcgttttttcttgggagcgccgctgcccaggctggcataatcgggcacgtcatagggatacgtacgaccggtccgacctccacctttgtagagctcatccatgccatgtgtaatcccagcagcagttacaaactcaagaaggaccatgtggtcacgcttttcgttgggatctttcgaaaggacagattgtgtcgacaggtaatggttgtctggtaaaaggacagggccatcgccaattggagtattttgttgataatggtctgctagttgaacggaaccatcttcaacgttgtggcgaattttgaagttagctttgattccattcttttgtttgtctgccgtgatgtatacattgtgtgagttaaagttgtactcgagtttgtgtccaagaatgtttccatcttctttaaaatcaataccctttaactcgatacgattaacaagggtatcaccttcaaacttgacttcagcacgcgtcttgtaggtcccgtcatctttgaaagatatagtgcgttcctgtacataaccttcgggcatggcactcttgaaaaagtcatgccgtttcatgtgatccggataacgggaaaagcattgaacaccataggtcagagtagtgacaagtgttggccacggaacaggtagttttccagtagtgcaaataaatttaagggtgagttttccgtttgtagcatcaccttcaccctctccacggacagaaaatttgtgcccattaacatcaccatctaattcaacaagaattgggacaactccagtgaaaagttcttctcctttgctaccgcttccacctccacctggatccaagcttccgccgcctcctgaaccaccaccgccactacctcctcccccagaacctccgcctccaccagcgtaatctggaacatcgtatgggtagctgctcacggtcaccagggtgccctggccccagtagtcgaacaggccggtcacgcagtagtacagggcggtgtcgtcgctgcgcaccttgctcatctgcaggtacacggtgttcttgccgttgtccttgctgatgatgaagcggtccttcagggcgctgttgtagtcggtgatgccgtcgccccagatcacgccgatccactccaggccgcggccgggggcctggcgcacccagttcacgccgtagtcggtcaggctgaagccgctcacggcgcagctcagcttcaggctgccgccgggctgcaccaggccgccgccgctctccagcagcttcacctcgctgccgccgccgctgctgccgccgccgccgctgccgccgccgccgctgccgccgccgccgcgcttcagctccaccttggtgccctggccgaacacccagtggttgctgtaccacagggcgcagaagtaggtggcgaagtcctcgggctgcaggctgctgatggtcagggtggccttgtcgccgatcaggctgccgctgaagcggctgggcacgccgggggcgcggttgttggtgccgccgatcaggcccttgaacagcttgccgggcttctcctgcacccagctggcgtagttgctggtggtcacggcgccggtgctgctgcggcaggtgatggtcacgcggtcgcccacgctggcgctcaggctgctggggctctgggtcatcacgatgtcggggcccataaaccctaggtgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactcatatgcatcctaggaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggaagatgctccaaagaagaagagaaaggtcgacggcattggtagtgggagcaacggcagcagcggatccaacggtccgactgacgccgcggaagaagaacttttgagcaagaattatcatcttgagaacgaagtggctcgtcttaagaaaggttctggcagtggaggttctggctccggatctggtggttcgggctcaggcgggtccggatcaggcgaagaactgctttcaaagaattaccacctggaaaatgaggtagctagactgaaaaaggggagcggaagtgggggctccgggtcgggctcagggggctccggttcgggaggctcagggtcgggggaggagttgctgagcaaaaattatcatttggagaacgaagtagcacgactaaagaaagggtccggatcgggtggttcaggatctggatccggaggatcagggtccggtgggtcgggctcaggagaggagttactctcgaaaaattatcatctcgaaaacgaagtggctcggctaaaaaagggcagtggttctggaggatctgggtcggggtcaggcgggtctggatctgggggatctggatctggtgaagagctattatctaaaaactaccacctcgaaaatgaggtggcacgcttaaaaaagggaagtggcagtggtgggtcgggatctggctctggtggctcaggctcgggaggttcaggttccggggaagagctactatccaagaattatcatcttgagaacgaggtagcgcgtttgaagaagggttccggctcaggaggatctgggtcagggtcagggggttccgggtcaggcgggtccgggtcaggcgaggaactgctctcgaagaactatcatcttgaaaatgaggtcgctcgattaaaaaagggatcgggcagtggtgggtccggctccggttccggaggatcgggatctgggggctcgggatccggggaggaactactttcaaagaattaccacctcgaaaacgaagtagctcgattaaagaaaggttcagggtcgggtggctcaggttcgggatcaggtgggtcaggctccggtggttcaggttcgggagaagaattactgagtaaaaattatcatctggaaaatgaggtagcgagactaaaaaaggggagtggttctggcggttcgggatctggctctgggggctctgggtcgggagggtctgggtctggcgaggaattgctatcgaaaaattatcatcttgagaacgaagttgctaggctcaaaaagggctcaggctcaggcgggtccgggtcagggtcgggaggttccggatccgggggatcaggctcagggtaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 106 - DNA, 16825 bp, Artificial Sequence
  Synthetic Construct
aaaaaaagcaccgactcggtgccactttttcaagttgataacggactagccttattttaacttgctatttctagctctaaaacaagcccatacatctttccgtcaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacgtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaacttacggccatggcgtaggcggccttttccgttgtgatcttcgcggtctcctccttgtttttggactagtaccaccaccgctaccaccaccttcggttaccgtgaaggttttggtagcgtcgtcgtaggtccattcaccgtcaacaccgttgtcgttagcgtactgtttgaaaactttttccgcggtagcagcgtcaacagcttcggtggtggtttcacctttcagggttttaccgttcaggataagcttgtactcttcggtccgagatcctcctcccgtacgtcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagcccggatccgccaccgcccactttccgctttttcttaggagcttccaccttgcgttttttcttgggagcgccgctgcccaggctggcataatcgggcacgtcatagggatacgtacgaccggtccgacctccacctttgtagagctcatccatgccatgtgtaatcccagcagcagttacaaactcaagaaggaccatgtggtcacgcttttcgttgggatctttcgaaaggacagattgtgtcgacaggtaatggttgtctggtaaaaggacagggccatcgccaattggagtattttgttgataatggtctgctagttgaacggaaccatcttcaacgttgtggcgaattttgaagttagctttgattccattcttttgtttgtctgccgtgatgtatacattgtgtgagttaaagttgtactcgagtttgtgtccaagaatgtttccatcttctttaaaatcaataccctttaactcgatacgattaacaagggtatcaccttcaaacttgacttcagcacgcgtcttgtaggtcccgtcatctttgaaagatatagtgcgttcctgtacataaccttcgggcatggcactcttgaaaaagtcatgccgtttcatgtgatccggataacgggaaaagcattgaacaccataggtcagagtagtgacaagtgttggccacggaacaggtagttttccagtagtgcaaataaatttaagggtgagttttccgtttgtagcatcaccttcaccctctccacggacagaaaatttgtgcccattaacatcaccatctaattcaacaagaattgggacaactccagtgaaaagttcttctcctttgctaccgcttccacctccacctggatccaagcttccgccgcctcctgaaccaccaccgccactacctcctcccccagaacctccgcctccaccagcgtaatctggaacatcgtatgggtagctgctcacggtcaccagggtgccctggccccagtagtcgaacaggccggtcacgcagtagtacagggcggtgtcgtcgctgcgcaccttgctcatctgcaggtacacggtgttcttgccgttgtccttgctgatgatgaagcggtccttcagggcgctgttgtagtcggtgatgccgtcgccccagatcacgccgatccactccaggccgcggccgggggcctggcgcacccagttcacgccgtagtcggtcaggctgaagccgctcacggcgcagctcagcttcaggctgccgccgggctgcaccaggccgccgccgctctccagcagcttcacctcgctgccgccgccgctgctgccgccgccgccgctgccgccgccgccgctgccgccgccgccgcgcttcagctccaccttggtgccctggccgaacacccagtggttgctgtaccacagggcgcagaagtaggtggcgaagtcctcgggctgcaggctgctgatggtcagggtggccttgtcgccgatcaggctgccgctgaagcggctgggcacgccgggggcgcggttgttggtgccgccgatcaggcccttgaacagcttgccgggcttctcctgcacccagctggcgtagttgctggtggtcacggcgccggtgctgctgcggcaggtgatggtcacgcggtcgcccacgctggcgctcaggctgctggggctctgggtcatcacgatgtcggggcccataaaccctaggtgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactcatatgcatcctaggaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggaagatgctccaaagaagaagagaaaggtcgacggcattggtagtgggagcaacggcagcagcggatccaacggtccgactgacgccgcggaagaagaacttttgagcaagaattatcatcttgagaacgaagtggctcgtcttaagaaaggttctggcagtggaggttctggctccggaggttccggcggggaagaactgctttcaaagaattaccacctggaaaatgaggtagctagactgaaaaaggggagcggaagtgggggctccgggtcgggcggctctgggggagaggagttgctgagcaaaaattatcatttggagaacgaagtagcacgactaaagaaagggtccggatcgggtggttcaggatctggaggttcgggtggggaggagttactctcgaaaaattatcatctcgaaaacgaagtggctcggctaaaaaagggcagtggttctggaggatctgggtcggggggatccgggggtgaagagctattatctaaaaactaccacctcgaaaatgaggtggcacgcttaaaaaagggaagtggcagtggtgggtcgggatctggcgggtcgggtggagaagagctactatccaagaattatcatcttgagaacgaggtagcgcgtttgaagaagggttccggctcaggaggatctgggtcagggggctcaggaggggaggaactgctctcgaagaactatcatcttgaaaatgaggtcgctcgattaaaaaagggatcgggcagtggtgggtccggctccggtggttcggggggcgaggaactactttcaaagaattaccacctcgaaaacgaagtagctcgattaaagaaaggttcagggtcgggtggctcaggttcgggaggatccggcggtgaagaattactgagtaaaaattatcatctggaaaatgaggtagcgagactaaaaaaggggagtggttctggcggttcgggatctggcgggtcgggaggggaggaattgctatcgaaaaattatcatcttgagaacgaagttgctaggctcaaaaagggctcaggctcaggcgggtccgggtcagggggctcaggtggctaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 107 - DNA, 553 bp, Artificial Sequence
  Synthetic Construct
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgacggaaagatgtatgggcttgttttagagctagaaatagcaagttaaaataaggctagtccgttatcaacttgaaaaagtggcaccgagtcggtgcttttttt

SEQ ID NO: 108 - DNA, 1994 bp, Artificial Sequence; identical to SEQ ID NO: 81
  Synthetic Construct

SEQ ID NO: 109 - DNA, 115 bp, Artificial Sequence; identical to SEQ ID NO: 33
  Synthetic Construct

SEQ ID NO: 110 - DNA, 4107 bp, Artificial Sequence; identical to SEQ ID NO: 34
  Synthetic Construct

SEQ ID NO: 111 - DNA, 27 bp, Artificial Sequence
  Synthetic Construct
tatccctatgacgtgcccgattatgcc

SEQ ID NO: 112 - DNA, 78 bp, Artificial Sequence
  Synthetic Construct
cccaagaaaaaacgcaaggtggaagatcctaagaaaaagcggaaagtggaagatgctccaaagaagaagagaaaggtc

SEQ ID NO: 113 - DNA, 48 bp, Artificial Sequence; identical to SEQ ID NO: 36
  Synthetic Construct

SEQ ID NO: 114 - DNA, 60 bp, Artificial Sequence; identical to SEQ ID NO: 86
  Synthetic Construct

SEQ ID NO: 115 - DNA, 1236 bp, Artificial Sequence
  Synthetic Construct
gaagaagaacttttgagcaagaattatcatcttgagaacgaagtggctcgtcttaagaaaggttctggcagtggaggttctggctccggatctggtggttcgggctcaggcgggtccggatcaggcgaagaactgctttcaaagaattaccacctggaaaatgaggtagctagactgaaaaaggggagcggaagtgggggctccgggtcgggctcagggggctccggttcgggaggctcagggtcgggggaggagttgctgagcaaaaattatcatttggagaacgaagtagcacgactaaagaaagggtccggatcgggtggttcaggatctggatccggaggatcagggtccggtgggtcgggctcaggagaggagttactctcgaaaaattatcatctcgaaaacgaagtggctcggctaaaaaagggcagtggttctggaggatctgggtcggggtcaggcgggtctggatctgggggatctggatctggtgaagagctattatctaaaaactaccacctcgaaaatgaggtggcacgcttaaaaaagggaagtggcagtggtgggtcgggatctggctctggtggctcaggctcgggaggttcaggttccggggaagagctactatccaagaattatcatcttgagaacgaggtagcgcgtttgaagaagggttccggctcaggaggatctgggtcagggtcagggggttccgggtcaggcgggtccgggtcaggcgaggaactgctctcgaagaactatcatcttgaaaatgaggtcgctcgattaaaaaagggatcgggcagtggtgggtccggctccggttccggaggatcgggatctgggggctcgggatccggggaggaactactttcaaagaattaccacctcgaaaacgaagtagctcgattaaagaaaggttcagggtcgggtggctcaggttcgggatcaggtgggtcaggctccggtggttcaggttcgggagaagaattactgagtaaaaattatcatctggaaaatgaggtagcgagactaaaaaaggggagtggttctggcggttcgggatctggctctgggggctctgggtcgggagggtctgggtctggcgaggaattgctatcgaaaaattatcatcttgagaacgaagttgctaggctcaaaaagggctcaggctcaggcgggtccgggtcagggtcgggaggttccggatccgggggatcaggctcagggtaa

SEQ ID NO: 116 - DNA, 996 bp, Artificial Sequence
  Synthetic Construct
gaagaagaacttttgagcaagaattatcatcttgagaacgaagtggctcgtcttaagaaaggttctggcagtggaggttctggctccggaggttccggcggggaagaactgctttcaaagaattaccacctggaaaatgaggtagctagactgaaaaaggggagcggaagtgggggctccgggtcgggcggctctgggggagaggagttgctgagcaaaaattatcatttggagaacgaagtagcacgactaaagaaagggtccggatcgggtggttcaggatctggaggttcgggtggggaggagttactctcgaaaaattatcatctcgaaaacgaagtggctcggctaaaaaagggcagtggttctggaggatctgggtcggggggatccgggggtgaagagctattatctaaaaactaccacctcgaaaatgaggtggcacgcttaaaaaagggaagtggcagtggtgggtcgggatctggcgggtcgggtggagaagagctactatccaagaattatcatcttgagaacgaggtagcgcgtttgaagaagggttccggctcaggaggatctgggtcagggggctcaggaggggaggaactgctctcgaagaactatcatcttgaaaatgaggtcgctcgattaaaaaagggatcgggcagtggtgggtccggctccggtggttcggggggcgaggaactactttcaaagaattaccacctcgaaaacgaagtagctcgattaaagaaaggttcagggtcgggtggctcaggttcgggaggatccggcggtgaagaattactgagtaaaaattatcatctggaaaatgaggtagcgagactaaaaaaggggagtggttctggcggttcgggatctggcgggtcgggaggggaggaattgctatcgaaaaattatcatcttgagaacgaagttgctaggctcaaaaagggctcaggctcaggcgggtccgggtcagggggctcaggtggctaa

SEQ ID NO: 117 - DNA, 394 bp, Artificial Sequence
  Synthetic Construct
tagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 118 - DNA, 2018 bp, Artificial Sequence
  Synthetic Construct
ttcctaacacctggagaaccttttatgtacttcacaaccctcaatgctgcttccaggtgtgactgtttgggttgctgcatgaattgactcagcacctgcactgcaaagctgatatctggccttgtgattgtcaagtagagaagctttcccaccagtctctgataggaacccacatcctctaactctgcatcatcagtctttcctaagtgcttgtcatattctacagtagtcagcctttggttctgttccattggggttgacactggtctgcagcctcccagaccaacacctgatatcagttccagtgcatacttcctctggttcagtaggattcccttttctgatctcagcacctcaatgcctaagaagtattttagttctcccaaatctttcatcttgaaatgctgatgcagggttgcctttgcttctgaaatcaaaacattgctgctgcctgttattaacagatcatccacataaatcaggattatgacaaggtcagtcccctctcttttggtaaacaaggagtgatcataagcactttgcataaaaccagcctgcataaggacagtggtaagcttgatgttccactgccttgatgcttgctttaaaccatagagggattcaacagcctgcacactttggtctccccttggctgtgaaaaccctgaggcagagacatataaacttcttccatgaggtcaccttgtagaaaagcattgttgacatccatctggaaaaggaaccagcccttggaagcagcaacagatatgacagcttttacagtgaccattttggccactggagaaaaagtttcatggtagtcaaggccttcttgctgagtgtatcccttggccactagccttgccttaaacctgtcaacttcaccattagctttgtatttaattttgtacacccatttggaccctataggctgtttaccagggggtaaagggacaatctcccaggtgttattatcctcaagagcctgtatctcaagggacatggcctccatccatttctcatcttgagctgcttctttgaaggatttaggttcagtataagtggagaaagcactcaaataagcttgatagtgaacaggcaagtgatcataggaaacatagttggctatagggtatggaacatccctagagcctttgttcagtgtcacaaagtccttgagccagatgggaggacctgcattgcgtttaggtctagtgtgcaggtttgctggaactagagagggatcagctacagcagtatggtgctcaaattcagcatttgctaggtcaggctcagctgactcaactgactctgcaggagcatgcaggtggcctgaaggtgcagcatcagctgaagtgatatgattttgggtagaatgagtccccaaagtgatatcctcattggcctctacaatgtcaggaataagaactggagtatcatcatcatcagtatgaaagctggaaggaaaaatatcattatacactagctgcaaagctgtatcttcagagctaagtgaacctgctcgagtgaacatatcaggttcatgggagatggactctttgaaagggaactgaaactctctgaaaactacatccctgctcactatgatcaccttattatccaagtcatacaacctgtaacccttttgagtctcagaataaccaatgaagatggttcgcttggctctaggtgcaagtttgtcacctttgggcagtgttgctgcaaaagcaagacacccaaacactctcaagtgatcaagcttggcatgtttctgatagagtagttcatatggacatttgccttgtaagattggagtagggagtctattgatcaggtatacaacagtcttgacacagtctccccaaaacctggtaggtacaccactctgaaacttaagtgcccttgccatctcaaggatgtgtctgtgctttctctccacaacaccattctgttgtggtgtgtagggacagctactttgatgaacaatcccaagagaggccagcaactcattacaactt

SEQ ID NO: 119 - DNA, 831 bp, Artificial Sequence; identical to SEQ ID NO: 90
  Synthetic Construct

SEQ ID NO: 120 - DNA, 711 bp, Artificial Sequence; identical to SEQ ID NO: 91
  Synthetic Construct

SEQ ID NO: 121 - DNA, 2157 bp, Artificial Sequence; identical to SEQ ID NO: 38
  Synthetic Construct

SEQ ID NO: 122 - DNA, 263 bp, Artificial Sequence; identical to SEQ ID NO: 93
  Synthetic Construct

SEQ ID NO: 123 - protein, 1841 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVEDAPKKKRKVDGIGSGSNGSSGSNGPTDAAEEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSGEELLSKNYHLENEVARLKKGSGSGGSGSGSGGSGSGGSGSG

SEQ ID NO: 124 - protein, 1761 aa, Artificial Sequence
  Synthetic Construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVEDAPKKKRKVDGIGSGSNGSSGSNGPTDAAEEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGG

SEQ ID NO: 125 - protein, 1369 aa, Artificial Sequence; identical to SEQ ID NO: 41
  Synthetic Construct

SEQ ID NO: 126 - protein, 9 aa, Artificial Sequence
  Synthetic Construct
YPYDVPDYA

SEQ ID NO: 127 - protein, 26 aa, Artificial Sequence
  Synthetic Construct
PKKKRKVEDPKKKRKVEDAPKKKRKV

SEQ ID NO: 128 - protein, 20 aa, Artificial Sequence
  Synthetic Construct
DGIGSGSNGSSGSNGPTDAA

SEQ ID NO: 129 - protein, 411 aa, Artificial Sequence; identical to SEQ ID NO: 104
  Synthetic Construct

SEQ ID NO: 130 - protein, 331 aa, Artificial Sequence
  Synthetic Construct
EEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGGEELLSKNYHLENEVARLKKGSGSGGSGSGGSGG

SEQ ID NO: 131 - protein, 1286 aa, Artificial Sequence; identical to SEQ ID NO: 100
  Synthetic Construct

SEQ ID NO: 132 - protein, 277 aa, Artificial Sequence; identical to SEQ ID NO: 101
  Synthetic Construct

SEQ ID NO: 133 - protein, 237 aa, Artificial Sequence; identical to SEQ ID NO: 102
  Synthetic Construct

SEQ ID NO: 134 - protein, 9 aa, Artificial Sequence
  Synthetic Construct
YPYDVPDYA

SEQ ID NO: 135 - protein, 16 aa, Artificial Sequence
  Synthetic Construct
PKKKRKVEAPKKKRKV

SEQ ID NO: 136 - protein, 6 aa, Artificial Sequence
  Synthetic Construct
GGGGSG

SEQ ID NO: 137 - protein, 718 aa, Artificial Sequence; identical to SEQ ID NO: 8
  Synthetic Construct

SEQ ID NO: 138 - protein, 19 aa, Artificial Sequence
  Synthetic Construct
EELLSKNYHLENEVARLKK

SEQ ID NO: 139 - DNA, 27 bp, Artificial Sequence
  Synthetic Construct
ttggatccaggtggaggtggaagcggt

SEQ ID NO: 140 - DNA, 18 bp, Artificial Sequence
  Synthetic Construct
ggcggtggcggatccggg

SEQ ID NO: 141 - protein, 9 aa, Artificial Sequence
  Synthetic Construct
LDPGGGGSG

SEQ ID NO: 142 - DNA, 17065 bp, Artificial Sequence
  Synthetic Construct
aaaaaaagcaccgactcggtgccactttttcaagttgataacggactagccttattttaacttgctatttctagctctaaaacctactgctatcaatgaggaccaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacgtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaacttacggccatggcgtaggcggccttttccgttgtgatcttcgcggtctcctccttgtttttggactagtaccaccaccgctaccaccaccttcggttaccgtgaaggttttggtagcgtcgtcgtaggtccattcaccgtcaacaccgttgtcgttagcgtactgtttgaaaactttttccgcggtagcagcgtcaacagcttcggtggtggtttcacctttcagggttttaccgttcaggataagcttgtactcttcggtccgagatcctcctcccgtacgtcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagcccggatccgccaccgcccactttccgctttttcttaggagcttccaccttgcgttttttcttgggagcgccgctgcccaggctggcataatcgggcacgtcatagggatacgtacgaccggtccgacctccacctttgtagagctcatccatgccatgtgtaatcccagcagcagttacaaactcaagaaggaccatgtggtcacgcttttcgttgggatctttcgaaaggacagattgtgtcgacaggtaatggttgtctggtaaaaggacagggccatcgccaattggagtattttgttgataatggtctgctagttgaacggaaccatcttcaacgttgtggcgaattttgaagttagctttgattccattcttttgtttgtctgccgtgatgtatacattgtgtgagttaaagttgtactcgagtttgtgtccaagaatgtttccatcttctttaaaatcaataccctttaactcgatacgattaacaagggtatcaccttcaaacttgacttcagcacgcgtcttgtaggtcccgtcatctttgaaagatatagtgcgttcctgtacataaccttcgggcatggcactcttgaaaaagtcatgccgtttcatgtgatccggataacgggaaaagcattgaacaccataggtcagagtagtgacaagtgttggccacggaacaggtagttttccagtagtgcaaataaatttaagggtgagttttccgtttgtagcatcaccttcaccctctccacggacagaaaatttgtgcccattaacatcaccatctaattcaacaagaattgggacaactccagtgaaaagttcttctcctttgctaccgcttccacctccacctggatccaagcttccgccgcctcctgaaccaccaccgccactacctcctcccccagaacctccgcctccaccagcgtaatctggaacatcgtatgggtagctgctcacggtcaccagggtgccctggccccagtagtcgaacaggccggtcacgcagtagtacagggcggtgtcgtcgctgcgcaccttgctcatctgcaggtacacggtgttcttgccgttgtccttgctgatgatgaagcggtccttcagggcgctgttgtagtcggtgatgccgtcgccccagatcacgccgatccactccaggccgcggccgggggcctggcgcacccagttcacgccgtagtcggtcaggctgaagccgctcacggcgcagctcagcttcaggctgccgccgggctgcaccaggccgccgccgctctccagcagcttcacctcgctgccgccgccgctgctgccgccgccgccgctgccgccgccgccgctgccgccgccgccgcgcttcagctccaccttggtgccctggccgaacacccagtggttgctgtaccacagggcgcagaagtaggtggcgaagtcctcgggctgcaggctgctgatggtcagggtggccttgtcgccgatcaggctgccgctgaagcggctgggcacgccgggggcgcggttgttggtgccgccgatcaggcccttgaacagcttgccgggcttctcctgcacccagctggcgtagttgctggtggtcacggcgccggtgctgctgcggcaggtgatggtcacgcggtcgcccacgctggcgctcaggctgctggggctctgggtcatcacgatgtcggggcccataaaccctaggtgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactcatatgcatcctaggaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggaagatgctccaaagaagaagagaaaggtcgacggcattggtagtgggagcaacggcagcagcggatccaacggtccgactgacgccgcggaagaagaacttttgagcaagaattatcatcttgagaacgaagtggctcgtcttaagaaaggttctggcagtggaggttctggctccggatctggtggttcgggctcaggcgggtccggatcaggcgaagaactgctttcaaagaattaccacctggaaaatgaggtagctagactgaaaaaggggagcggaagtgggggctccgggtcgggctcagggggctccggttcgggaggctcagggtcgggggaggagttgctgagcaaaaattatcatttggagaacgaagtagcacgactaaagaaagggtccggatcgggtggttcaggatctggatccggaggatcagggtccggtgggtcgggctcaggagaggagttactctcgaaaaattatcatctcgaaaacgaagtggctcggctaaaaaagggcagtggttctggaggatctgggtcggggtcaggcgggtctggatctgggggatctggatctggtgaagagctattatctaaaaactaccacctcgaaaatgaggtggcacgcttaaaaaagggaagtggcagtggtgggtcgggatctggctctggtggctcaggctcgggaggttcaggttccggggaagagctactatccaagaattatcatcttgagaacgaggtagcgcgtttgaagaagggttccggctcaggaggatctgggtcagggtcagggggttccgggtcaggcgggtccgggtcaggcgaggaactgctctcgaagaactatcatcttgaaaatgaggtcgctcgattaaaaaagggatcgggcagtggtgggtccggctccggttccggaggatcgggatctgggggctcgggatccggggaggaactactttcaaagaattaccacctcgaaaacgaagtagctcgattaaagaaaggttcagggtcgggtggctcaggttcgggatcaggtgggtcaggctccggtggttcaggttcgggagaagaattactgagtaaaaattatcatctggaaaatgaggtagcgagactaaaaaaggggagtggttctggcggttcgggatctggctctgggggctctgggtcgggagggtctgggtctggcgaggaattgctatcgaaaaattatcatcttgagaacgaagttgctaggctcaaaaagggctcaggctcaggcgggtccgggtcagggtcgggaggttccggatccgggggatcaggctcagggtaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 143 - DNA, 553 bp, Artificial Sequence
  Synthetic Construct
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattggtcctcattgatagcagtaggttttagagctagaaatagcaagttaaaataaggctagtccgttatcaacttgaaaaagtggcaccgagtcggtgcttttttt

SEQ ID NO: 144 - DNA, 17065 bp, Artificial Sequence
  Synthetic Construct
aaaaaaagcaccgactcggtgccactttttcaagttgataacggactagccttattttaacttgctatttctagctctaaaacctgatatgggagctagtgtacaatcactacttcgactctagctgtatataaactcagcttcgttttcttatctaagcgatgtgggacttttgaagattgttttcaacttaaatgggcctatataagaaatactattgttctttcccatataaatgggcctgcttctcttctttcagattcccaggggccttttgaagattatcttcatatcttaagaatgaagatgttttattcaatcaaattcttgaaggttcgatgcctaatcattctaatcctgggacaaactatgaaacaagatacaaaaactccgaatggaaagttaaaaagaagaaaacgaaagctacggttcaagaaaatgtaagctgataaacaaaaaaaaactgtatgaacgaagaagaagaaaaaaagctaagaagaaatgatgtattgtgcggaaggcaagtcgagtttccgttgttcaacgaaagcttaaacgtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaacttacggccatggcgtaggcggccttttccgttgtgatcttcgcggtctcctccttgtttttggactagtaccaccaccgctaccaccaccttcggttaccgtgaaggttttggtagcgtcgtcgtaggtccattcaccgtcaacaccgttgtcgttagcgtactgtttgaaaactttttccgcggtagcagcgtcaacagcttcggtggtggtttcacctttcagggttttaccgttcaggataagcttgtactcttcggtccgagatcctcctcccgtacgtcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagcccggatccgccaccgcccactttccgctttttcttaggagcttccaccttgcgttttttcttgggagcgccgctgcccaggctggcataatcgggcacgtcatagggatacgtacgaccggtccgacctccacctttgtagagctcatccatgccatgtgtaatcccagcagcagttacaaactcaagaaggaccatgtggtcacgcttttcgttgggatctttcgaaaggacagattgtgtcgacaggtaatggttgtctggtaaaaggacagggccatcgccaattggagtattttgttgataatggtctgctagttgaacggaaccatcttcaacgttgtggcgaattttgaagttagctttgattccattcttttgtttgtctgccgtgatgtatacattgtgtgagttaaagttgtactcgagtttgtgtccaagaatgtttccatcttctttaaaatcaataccctttaactcgatacgattaacaagggtatcaccttcaaacttgacttcagcacgcgtcttgtaggtcccgtcatctttgaaagatatagtgcgttcctgtacataaccttcgggcatggcactcttgaaaaagtcatgccgtttcatgtgatccggataacgggaaaagcattgaacaccataggtcagagtagtgacaagtgttggccacggaacaggtagttttccagtagtgcaaataaatttaagggtgagttttccgtttgtagcatcaccttcaccctctccacggacagaaaatttgtgcccattaacatcaccatctaattcaacaagaattgggacaactccagtgaaaagttcttctcctttgctaccgcttccacctccacctggatccaagcttccgccgcctcctgaaccaccaccgccactacctcctcccccagaacctccgcctccaccagcgtaatctggaacatcgtatgggtagctgctcacggtcaccagggtgccctggccccagtagtcgaacaggccggtcacgcagtagtacagggcggtgtcgtcgctgcgcaccttgctcatctgcaggtacacggtgttcttgccgttgtccttgctgatgatgaagcggtccttcagggcgctgttgtagtcggtgatgccgtcgccccagatcacgccgatccactccaggccgcggccgggggcctggcgcacccagttcacgccgtagtcggtcaggctgaagccgctcacggcgcagctcagcttcaggctgccgccgggctgcaccaggccgccgccgctctccagcagcttcacctcgctgccgccgccgctgctgccgccgccgccgctgccgccgccgccgctgccgccgccgccgcgcttcagctccaccttggtgccctggccgaacacccagtggttgctgtaccacagggcgcagaagtaggtggcgaagtcctcgggctgcaggctgctgatggtcagggtggccttgtcgccgatcaggctgccgctgaagcggctgggcacgccgggggcgcggttgttggtgccgccgatcaggcccttgaacagcttgccgggcttctcctgcacccagctggcgtagttgctggtggtcacggcgccggtgctgctgcggcaggtgatggtcacgcggtcgcccacgctggcgctcaggctgctggggctctgggtcatcacgatgtcggggcccataaaccctaggtgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactcatatgcatcctaggaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggaagatgctccaaagaagaagagaaaggtcgacggcattggtagtgggagcaacggcagcagcggatccaacggtccgactgacgccgcggaagaagaacttttgagcaagaattatcatcttgagaacgaagtggctcgtcttaagaaaggttctggcagtggaggttctggctccggatctggtggttcgggctcaggcgggtccggatcaggcgaagaactgctttcaaagaattaccacctggaaaatgaggtagctagactgaaaaaggggagcggaagtgggggctccgggtcgggctcagggggctccggttcgggaggctcagggtcgggggaggagttgctgagcaaaaattatcatttggagaacgaagtagcacgactaaagaaagggtccggatcgggtggttcaggatctggatccggaggatcagggtccggtgggtcgggctcaggagaggagttactctcgaaaaattatcatctcgaaaacgaagtggctcggctaaaaaagggcagtggttctggaggatctgggtcggggtcaggcgggtctggatctgggggatctggatctggtgaagagctattatctaaaaactaccacctcgaaaatgaggtggcacgcttaaaaaagggaagtggcagtggtgggtcgggatctggctctggtggctcaggctcgggaggttcaggttccggggaagagctactatccaagaattatcatcttgagaacgaggtagcgcgtttgaagaagggttccggctcaggaggatctgggtcagggtcagggggttccgggtcaggcgggtccgggtcaggcgaggaactgctctcgaagaactatcatcttgaaaatgaggtcgctcgattaaaaaagggatcgggcagtggtgggtccggctccggttccggaggatcgggatctgggggctcgggatccggggaggaactactttcaaagaattaccacctcgaaaacgaagtagctcgattaaagaaaggttcagggtcgggtggctcaggttcgggatcaggtgggtcaggctccggtggttcaggttcgggagaagaattactgagtaaaaattatcatctggaaaatgaggtagcgagactaaaaaaggggagtggttctggcggttcgggatctggctctgggggctctgggtcgggagggtctgggtctggcgaggaattgctatcgaaaaattatcatcttgagaacgaagttgctaggctcaaaaagggctcaggctcaggcgggtccgggtcagggtcgggaggttccggatccgggggatcaggctcagggtaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 145 - DNA, 553 bp, Artificial Sequence
  Synthetic Construct
aagctttcgttgaacaacggaaactcgacttgccttccgcacaatacatcatttcttcttagctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattgtacactagctcccatatcaggttttagagctagaaatagcaagttaaaataaggctagtccgttatcaacttgaaaaagtggcaccgagtcggtgcttttttt

SEQ ID NO: 146 - DNA, 5676 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggttgagaaaccttacaagtgcccggagtgcggaaagtctttttcacaaaactcaaccttgacggagcatcagcgaacacataccggggaaaagccgtataagtgtccggaatgcgggaaatctttttctaggtctgataacttggtgagacaccagcgtacacacacaggtgaaaagccttacaagtgcccagaatgcggaaagagcttcagcaccaccggcaatctgaccgtacatcagcgaactcatacaggtgagaaaccctataagtgtcctgagtgcggaaaatctttcagccaatcatcaaatttagtgagacatcagaggacccacacaggggagaagccgtataaatgtcccgagtgtgggaaaagtttctctcgatccgataacctggtacgacatcagcgaacccatactggtgagaagccctataaatgccctgaatgcggcaaatccttttccacgtccgggagcctagttaggcatcaacgaacccataccggtaaccgcgccaagcttggtaccgactacaaagacgatgacgacaaagactacaaagacgatgacgacaaagactacaaagacgatgacgacaaaggatcccttgaggttcttttcggcgcgccaagctatcaaacaagtttgtacaaaaaagcaggctccgcggccgcccccttcaccatgggatccctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaagggtgggcgcgccgacccagctttcttgtacaaagtggttcgataattcttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 147 - DNA, 5676 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggttgagaagccctataagtgccccgagtgtgggaagtctttcagcagggaagataacctccacactcatcaaagaacgcatacgggagaaaagccttacaaatgtccggaatgtgggaaatcattcagccaatcaagcaatctcgtgagacatcaacgtacacatacaggggaaaaaccatataagtgccccgaatgcggtaagtcattttcacaccgtactactctgacaaaccatcaacgtacccatactggggagaagccttataaatgtcctgagtgtgggaagagcttctctcagagggcgcatttggagcgtcaccagaggacacataccggcgaaaaaccgtacaaatgtcctgaatgtggaaagtcattctcacgtagtgacaatctcgtcaggcaccagcgtactcatactggagagaaaccctacaagtgtcctgaatgtggtaagtccttcagtcaatcctccagcctagtgagacatcaaaggacgcataccgggaaccgcgccaagcttggtaccgactacaaagacgatgacgacaaagactacaaagacgatgacgacaaagactacaaagacgatgacgacaaaggatcccttgaggttcttttcggcgcgccaagctatcaaacaagtttgtacaaaaaagcaggctccgcggccgcccccttcaccatgggatccctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaagggtgggcgcgccgacccagctttcttgtacaaagtggttcgataattcttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 148 - DNA, 510 bp, Artificial Sequence
  Synthetic Construct
atggttgagaaaccttacaagtgcccggagtgcggaaagtctttttcacaaaactcaaccttgacggagcatcagcgaacacataccggggaaaagccgtataagtgtccggaatgcgggaaatctttttctaggtctgataacttggtgagacaccagcgtacacacacaggtgaaaagccttacaagtgcccagaatgcggaaagagcttcagcaccaccggcaatctgaccgtacatcagcgaactcatacaggtgagaaaccctataagtgtcctgagtgcggaaaatctttcagccaatcatcaaatttagtgagacatcagaggacccacacaggggagaagccgtataaatgtcccgagtgtgggaaaagtttctctcgatccgataacctggtacgacatcagcgaacccatactggtgagaagccctataaatgccctgaatgcggcaaatccttttccacgtccgggagcctagttaggcatcaacgaacccataccggt

SEQ ID NO: 149 - DNA, 510 bp, Artificial Sequence
  Synthetic Construct
atggttgagaagccctataagtgccccgagtgtgggaagtctttcagcagggaagataacctccacactcatcaaagaacgcatacgggagaaaagccttacaaatgtccggaatgtgggaaatcattcagccaatcaagcaatctcgtgagacatcaacgtacacatacaggggaaaaaccatataagtgccccgaatgcggtaagtcattttcacaccgtactactctgacaaaccatcaacgtacccatactggggagaagccttataaatgtcctgagtgtgggaagagcttctctcagagggcgcatttggagcgtcaccagaggacacataccggcgaaaaaccgtacaaatgtcctgaatgtggaaagtcattctcacgtagtgacaatctcgtcaggcaccagcgtactcatactggagagaaaccctacaagtgtcctgaatgtggtaagtccttcagtcaatcctccagcctagtgagacatcaaaggacgcataccggg

SEQ ID NO: 150 - protein, 950 aa, Artificial Sequence
  Synthetic Construct
MVEKPYKCPECGKSFSQNSTLTEHQRTHTGEKPYKCPECGKSFSRSDNLVRHQRTHTGEKPYKCPECGKSFSTTGNLTVHQRTHTGEKPYKCPECGKSFSQSSNLVRHQRTHTGEKPYKCPECGKSFSRSDNLVRHQRTHTGEKPYKCPECGKSFSTSGSLVRHQRTHTGNRAKLGTDYKDDDDKDYKDDDDKDYKDDDDKGSLEVLFGAPSYQTSLYKKAGSAAAPFTMGSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 151 - protein, 950 aa, Artificial Sequence
  Synthetic Construct
MVEKPYKCPECGKSFSREDNLHTHQRTHTGEKPYKCPECGKSFSQSSNLVRHQRTHTGEKPYKCPECGKSFSHRTTLTNHQRTHTGEKPYKCPECGKSFSQRAHLERHQRTHTGEKPYKCPECGKSFSRSDNLVRHQRTHTGEKPYKCPECGKSFSQSSSLVRHQRTHTGNRAKLGTDYKDDDDKDYKDDDDKDYKDDDDKGSLEVLFGAPSYQTSLYKKAGSAAAPFTMGSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 152 - protein, 170 aa, Artificial Sequence
  Synthetic Construct
MVEKPYKCPECGKSFSQNSTLTEHQRTHTGEKPYKCPECGKSFSRSDNLVRHQRTHTGEKPYKCPECGKSFSTTGNLTVHQRTHTGEKPYKCPECGKSFSQSSNLVRHQRTHTGEKPYKCPECGKSFSRSDNLVRHQRTHTGEKPYKCPECGKSFSTSGSLVRHQRTHTG

SEQ ID NO: 153 - protein, 170 aa, Artificial Sequence
  Synthetic Construct
MVEKPYKCPECGKSFSREDNLHTHQRTHTGEKPYKCPECGKSFSQSSNLVRHQRTHTGEKPYKCPECGKSFSHRTTLTNHQRTHTGEKPYKCPECGKSFSQRAHLERHQRTHTGEKPYKCPECGKSFSRSDNLVRHQRTHTGEKPYKCPECGKSFSQSSSLVRHQRTHTG

SEQ ID NO: 154 - DNA, 5676 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatggttgaaaagccgtataaatgccctgagtgtggtaaaagttttagtgacccagggaatcttgtgagacaccagaggactcatacgggggaaaaaccttataagtgtccagagtgtggcaaaagcttctccacgagcggcaacctggtgaggcaccaaaggacgcatacaggtgaaaagccctataaatgcccagagtgtggtaagagttttagcgatcccggtaatctagtgagacatcagagaacacacactggtgaaaaaccatacaaatgccccgaatgcgggaagtctttttcaacaagtgggaacttggtccgacatcagcgtacacacacaggcgagaaaccttataagtgtccggagtgtggtaaatcatttagcacttccggaaacttggtacgtcatcagcgaacacacaccggggagaaaccgtacaaatgcccggaatgcggaaaatcattctccgatccaggcaatttagtaagacatcagcgaacccatacaggtaaccgcgccaagcttggtaccgactacaaagacgatgacgacaaagactacaaagacgatgacgacaaagactacaaagacgatgacgacaaaggatcccttgaggttcttttcggcgcgccaagctatcaaacaagtttgtacaaaaaagcaggctccgcggccgcccccttcaccatgggatccctgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgacccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgctgcagctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaagggtgggcgcgccgacccagctttcttgtacaaagtggttcgataattcttaattaactagttctagagcggccgccaccgcggtggagctcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacgagct

SEQ ID NO: 155 - DNA, 510 bp, Artificial Sequence
  Synthetic Construct
atggttgaaaagccgtataaatgccctgagtgtggtaaaagttttagtgacccagggaatcttgtgagacaccagaggactcatacgggggaaaaaccttataagtgtccagagtgtggcaaaagcttctccacgagcggcaacctggtgaggcaccaaaggacgcatacaggtgaaaagccctataaatgcccagagtgtggtaagagttttagcgatcccggtaatctagtgagacatcagagaacacacactggtgaaaaaccatacaaatgccccgaatgcgggaagtctttttcaacaagtgggaacttggtccgacatcagcgtacacacacaggcgagaaaccttataagtgtccggagtgtggtaaatcatttagcacttccggaaacttggtacgtcatcagcgaacacacaccggggagaaaccgtacaaatgcccggaatgcggaaaatcattctccgatccaggcaatttagtaagacatcagcgaacccatacaggt

SEQ ID NO: 156 - protein, 950 aa, Artificial Sequence
  Synthetic Construct
MVEKPYKCPECGKSFSDPGNLVRHQRTHTGEKPYKCPECGKSFSTSGNLVRHQRTHTGEKPYKCPECGKSFSDPGNLVRHQRTHTGEKPYKCPECGKSFSTSGNLVRHQRTHTGEKPYKCPECGKSFSTSGNLVRHQRTHTGEKPYKCPECGKSFSDPGNLVRHQRTHTGNRAKLGTDYKDDDDKDYKDDDDKDYKDDDDKGSLEVLFGAPSYQTSLYKKAGSAAAPFTMGSLPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 157 - protein, 170 aa, Artificial Sequence
  Synthetic Construct
MVEKPYKCPECGKSFSDPGNLVRHQRTHTGEKPYKCPECGKSFSTSGNLVRHQRTHTGEKPYKCPECGKSFSDPGNLVRHQRTHTGEKPYKCPECGKSFSTSGNLVRHQRTHTGEKPYKCPECGKSFSTSGNLVRHQRTHTGEKPYKCPECGKSFSDPGNLVRHQRTHTG

SEQ ID NO: 158 - DNA, 3530 bp, Artificial Sequence
  Synthetic Construct
agtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagacgcgtccatggttgggtaccaacaaatggctggtggacttaacgatatcttcgaagctcagaagattgaatggcatgaggatactggtggatctagcatccccggacttgaggttcttttccaaggacctctcgagccttataaatgccctgagtgtggaaaatctttctctcaatctggagatcttaggaggcaccaaaggacccataccggtgaaaaaccttataaatgccctgagtgtggaaaatcattcagtaggagtgatcatcttaccacccatcagaggacccatactggtgaaaaaccttataaatgccctgagtgtggaaaatcattctcacaatcttcatctcttgttaggcatcagaggactcataccggagaaaaaccttataaatgccctgagtgtggaaaatcattctcaacatctggaaaccttgttaggcaccaaaggacccatactggtgaaaaaccttataaatgccctgagtgtggaaaatcattctctcagagagcaaaccttagggctcatcaaaggacacacactggagaaaaaccttataaatgccctgagtgtggaaaatctttctctaggagtgataagctcaccgagcatcaaaggactcacaccggactcgaggactacaaagacgatgacgacaaagactacaaagacgatgacgacaaagactacaaagacgatgacgacaaaaagcttgatatcgccatggggggcgcgccaagctatcaaacaagtttgtacaaaaaagcaggctccgcggccgcccccttcaccctagaccctttgcctgctgctgctgccgctgtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataattag

SEQ ID NO: 159 - DNA, 747 bp, Artificial Sequence
  Synthetic Construct
ctagaccctttgcctgctgctgctgccgctgtgagcaaaggcgaagagctgttcaccggcgtggtgcccatcctggtggagctggacggcgacgtgaacggccacaagttcagcgtgagcggcgagggcgagggcgacgccacctacggcaagctgaccctgaagctgctgtgcaccaccggcaagctgcccgtgccctggcccaccctggtgaccaccctgggctacggcgtgcagtgcttcgcccggtaccccgaccacatgaagcagcacgacttcttcaagagcgccatgcccgagggctacgtgcaggagcggaccatcttcttcaaggacgacggcaactacaagacccgggccgaggtgaagttcgagggcgacaccctggtgaaccggatcgagctgaagggcatcgacttcaaggaggacggcaacatcctgggccacaagctggagtacaactacaacagccacaacgtgtacatcaccgccgacaagcagaagaacggcatcaaggccaacttcaagatccggcacaacatcgaggacggcggcgtgcagctggccgaccactaccagcagaacacccccatcggcgacggccccgtgctgctgcccgacaaccactacctgagctaccagagcgccctgttcaaggaccccaacgagaagcgggaccacatggtgctgctggagttcctgaccgccgccggcatcaccgagggcatgaacgagctctataattag

SEQ ID NO: 160 - protein, 511 aa, Artificial Sequence
  Synthetic Construct
MVGYQQMAGGLNDIFEAQKIEWHEDTGGSSIPGLEVLFQGPLEPYKCPECGKSFSQSGDLRRHQRTHTGEKPYKCPECGKSFSRSDHLTTHQRTHTGEKPYKCPECGKSFSQSSSLVRHQRTHTGEKPYKCPECGKSFSTSGNLVRHQRTHTGEKPYKCPECGKSFSQRANLRAHQRTHTGEKPYKCPECGKSFSRSDKLTEHQRTHTGLEDYKDDDDKDYKDDDDKDYKDDDDKKLDIAMGGAPSYQTSLYKKAGSAAAPFTLDPLPAAAAAVSKGEELFTGVVPILVELDGDVNGHKFSVSGEGEGDATYGKLTLKLLCTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALFKDPNEKRDHMVLLEFLTAAGITEGMNELYN

SEQ ID NO: 161 - protein, 248 aa, Artificial Sequence
  Synthetic Construct
LDPLPAAAAAVSKGEELFTGVVPILVELDGDVNGHKFSVSGEGEGDATYGKLTLKLLCTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALFKDPNEKRDHMVLLEFLTAAGITEGMNELYN

SEQ ID NO: 162 - DNA, 16530 bp, Artificial Sequence
  Synthetic Construct
cacggggtggtttggtttaaacgtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaacttacggccatggcgtaggcggccttttccgttgtgatcttcgcggtctcctccttgtttttggactagtaccaccaccgctaccaccaccttcggttaccgtgaaggttttggtagcgtcgtcgtaggtccattcaccgtcaacaccgttgtcgttagcgtactgtttgaaaactttttccgcggtagcagcgtcaacagcttcggtggtggtttcacctttcagggttttaccgttcaggataagcttgtactcttcggtccgagatcctcctcccgtacgtcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagcccggatccgccaccgcccactttccgctttttcttaggagcttccaccttgcgttttttcttgggagcgccgctgcccaggctggcataatcgggcacgtcatagggatacgtacgaccggtccgacctccacctttgtagagctcatccatgccatgtgtaatcccagcagcagttacaaactcaagaaggaccatgtggtcacgcttttcgttgggatctttcgaaaggacagattgtgtcgacaggtaatggttgtctggtaaaaggacagggccatcgccaattggagtattttgttgataatggtctgctagttgaacggaaccatcttcaacgttgtggcgaattttgaagttagctttgattccattcttttgtttgtctgccgtgatgtatacattgtgtgagttaaagttgtactcgagtttgtgtccaagaatgtttccatcttctttaaaatcaataccctttaactcgatacgattaacaagggtatcaccttcaaacttgacttcagcacgcgtcttgtaggtcccgtcatctttgaaagatatagtgcgttcctgtacataaccttcgggcatggcactcttgaaaaagtcatgccgtttcatgtgatccggataacgggaaaagcattgaacaccataggtcagagtagtgacaagtgttggccacggaacaggtagttttccagtagtgcaaataaatttaagggtgagttttccgtttgtagcatcaccttcaccctctccacggacagaaaatttgtgcccattaacatcaccatctaattcaacaagaattgggacaactccagtgaaaagttcttctcctttgctaccgcttccacctccacctggatccaagcttccgccgcctcctgaaccaccaccgccactacctcctcccccagaacctccgcctccaccagcgtaatctggaacatcgtatgggtagctgctcacggtcaccagggtgccctggccccagtagtcgaacaggccggtcacgcagtagtacagggcggtgtcgtcgctgcgcaccttgctcatctgcaggtacacggtgttcttgccgttgtccttgctgatgatgaagcggtccttcagggcgctgttgtagtcggtgatgccgtcgccccagatcacgccgatccactccaggccgcggccgggggcctggcgcacccagttcacgccgtagtcggtcaggctgaagccgctcacggcgcagctcagcttcaggctgccgccgggctgcaccaggccgccgccgctctccagcagcttcacctcgctgccgccgccgctgctgccgccgccgccgctgccgccgccgccgctgccgccgccgccgcgcttcagctccaccttggtgccctggccgaacacccagtggttgctgtaccacagggcgcagaagtaggtggcgaagtcctcgggctgcaggctgctgatggtcagggtggccttgtcgccgatcaggctgccgctgaagcggctgggcacgccgggggcgcggttgttggtgccgccgatcaggcccttgaacagcttgccgggcttctcctgcacccagctggcgtagttgctggtggtcacggcgccggtgctgctgcggcaggtgatggtcacgcggtcgcccacgctggcgctcaggctgctggggctctgggtcatcacgatgtcggggcccataaaccctaggtgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactcatatgcatcctaggaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggaagatgctccaaagaagaagagaaaggtcgacggcattggtagtgggagcaacggcagcagcggatccaacggtccgactgacgccgcggaagaagaacttttgagcaagaattatcatcttgagaacgaagtggctcgtcttaagaaaggttctggcagtggaggttctggctccggatctggtggttcgggctcaggcgggtccggatcaggcgaagaactgctttcaaagaattaccacctggaaaatgaggtagctagactgaaaaaggggagcggaagtgggggctccgggtcgggctcagggggctccggttcgggaggctcagggtcgggggaggagttgctgagcaaaaattatcatttggagaacgaagtagcacgactaaagaaagggtccggatcgggtggttcaggatctggatccggaggatcagggtccggtgggtcgggctcaggagaggagttactctcgaaaaattatcatctcgaaaacgaagtggctcggctaaaaaagggcagtggttctggaggatctgggtcggggtcaggcgggtctggatctgggggatctggatctggtgaagagctattatctaaaaactaccacctcgaaaatgaggtggcacgcttaaaaaagggaagtggcagtggtgggtcgggatctggctctggtggctcaggctcgggaggttcaggttccggggaagagctactatccaagaattatcatcttgagaacgaggtagcgcgtttgaagaagggttccggctcaggaggatctgggtcagggtcagggggttccgggtcaggcgggtccgggtcaggcgaggaactgctctcgaagaactatcatcttgaaaatgaggtcgctcgattaaaaaagggatcgggcagtggtgggtccggctccggttccggaggatcgggatctgggggctcgggatccggggaggaactactttcaaagaattaccacctcgaaaacgaagtagctcgattaaagaaaggttcagggtcgggtggctcaggttcgggatcaggtgggtcaggctccggtggttcaggttcgggagaagaattactgagtaaaaattatcatctggaaaatgaggtagcgagactaaaaaaggggagtggttctggcggttcgggatctggctctgggggctctgggtcgggagggtctgggtctggcgaggaattgctatcgaaaaattatcatcttgagaacgaagttgctaggctcaaaaagggctcaggctcaggcgggtccgggtcagggtcgggaggttccggatccgggggatcaggctcagggtaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 163 - DNA, 16290 bp, Artificial Sequence
  Synthetic Construct
cacggggtggtttggtttaaacgtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctcaaacttacggccatggcgtaggcggccttttccgttgtgatcttcgcggtctcctccttgtttttggactagtaccaccaccgctaccaccaccttcggttaccgtgaaggttttggtagcgtcgtcgtaggtccattcaccgtcaacaccgttgtcgttagcgtactgtttgaaaactttttccgcggtagcagcgtcaacagcttcggtggtggtttcacctttcagggttttaccgttcaggataagcttgtactcttcggtccgagatcctcctcccgtacgtcagacccaatggttatagggccccgcaacgtgtgtgagagcataaggggacacggtgacaacattgtcatgggttaatgttaatgctttatgagaaggaatttggttcaattcatttacttcagaggactgttctggaccttcattagctgcctggtctttttgctctgaggccttcattttcttattcttagcttctttagcctcaaacttaatcttgtttagttcaaaaccatgttggggcttatttaggtttttgtgctggtaaaagacaagggagaggcgggttggatgattacggttggggtgctcaacaggagtggtagcgtgcagctctcgccgggcacactcaatcaaaaccgagccgtgagcaggtgcgatggccaccccaccaatatttgcatccaaaaagatgtgctcactgtctgaccaatactcatcaatgtggggcaatttctcctcagcaggtgacagggggtcatcagataggggttcgtctgatggaggctcatctgcttcagaatgctgctcatcttcttccattggagaagaggcaaggtcttgaggagaggtgaggaaggagggctggtggtttggctgatgaggcgttagcggctcagtcacaccagtggaaggctcagaattaatgaggggctccatcacaggagcagacagggtggggagaggagccacttcgccaagctgtgaaatgccagggccatcagcagctgcagcattggcaccactgagtcttcccgaaggcatcgtacagtggggagtgctgcttctttctgaaaacccgcatgaggctgttgcgtcattcttcagtggagctggtgtggctgaagcagtcttcggggaccaggagaagcctggagatgcctctttcactgggtgaggagcggatggcatcagcgaataagttttagtgttgtctgaactttttaagataaaatggggttcggtttcactttttacttcaggttgcacggtctcagtgttactccctaaggttggcagtgacgaaggcttactgttgtttgttgttgttgagttattcttccgcttgattcggggaataggtttcttttccactgcccttatcttatgtgcaagaacctctgtcatcatcgcagccctcttctttccagaacggggaacaggctgagtgaaacacgttctttttttgcggcggggtgccaggacctcgatggccccagatttgatcttggcttccattccttccttggagccaaactcatctgtgtctgaaagcttataaagaggtagcacatggagctgctcatcttgaggaataacacccaaagagcggttatcttctcgagttaaggtacaaaccacagtgcttccattattcatgttgtgaatgtccctgtggggatgagcacagaagtccaggcaagcagtgaccccagagaagggtcgaccttccttgctgccaagccgacattctcgggcaacattttcatattccacctgattttggtaagctactggagcatactgcttataaattggagctaatcgtgtagccaaactctgtaagttatcttcaaggtttttttcatgtaagggagagcttggatcaattctaaatcttctggggcttgggcttctaccaaacttacagccattaaagtacatactccatgaacagccaaaagagaatgaagctccacaagtctctggatcaattccttgacatgtacaggtacgattttcattgagggtgcatcttctgtcggtagggtgcccattgtatgactttagattctctgtgagctctgtgtatagccggtcggccattggaagagggatgccatcccacaccatgatgagcaccaccatcacagcagttggacagtggtggcctgtacgctgccggaccaaacaaagaactttttcttcatcactgcttcttcttaaaacccacttagcaattggacacccatgagagcttttcccttctttaccggtgtacactactatttctatccttattgcgtttcctttttgaccatacctattctccatgatttccctgacagcagcaacacttggtcctgccccaaggtgtgtataatatgggcctttgtctttttgtataactcgatcaagacagctgcaggtgggcagcccggatccgccaccgcccactttccgctttttcttaggagcttccaccttgcgttttttcttgggagcgccgctgcccaggctggcataatcgggcacgtcatagggatacgtacgaccggtccgacctccacctttgtagagctcatccatgccatgtgtaatcccagcagcagttacaaactcaagaaggaccatgtggtcacgcttttcgttgggatctttcgaaaggacagattgtgtcgacaggtaatggttgtctggtaaaaggacagggccatcgccaattggagtattttgttgataatggtctgctagttgaacggaaccatcttcaacgttgtggcgaattttgaagttagctttgattccattcttttgtttgtctgccgtgatgtatacattgtgtgagttaaagttgtactcgagtttgtgtccaagaatgtttccatcttctttaaaatcaataccctttaactcgatacgattaacaagggtatcaccttcaaacttgacttcagcacgcgtcttgtaggtcccgtcatctttgaaagatatagtgcgttcctgtacataaccttcgggcatggcactcttgaaaaagtcatgccgtttcatgtgatccggataacgggaaaagcattgaacaccataggtcagagtagtgacaagtgttggccacggaacaggtagttttccagtagtgcaaataaatttaagggtgagttttccgtttgtagcatcaccttcaccctctccacggacagaaaatttgtgcccattaacatcaccatctaattcaacaagaattgggacaactccagtgaaaagttcttctcctttgctaccgcttccacctccacctggatccaagcttccgccgcctcctgaaccaccaccgccactacctcctcccccagaacctccgcctccaccagcgtaatctggaacatcgtatgggtagctgctcacggtcaccagggtgccctggccccagtagtcgaacaggccggtcacgcagtagtacagggcggtgtcgtcgctgcgcaccttgctcatctgcaggtacacggtgttcttgccgttgtccttgctgatgatgaagcggtccttcagggcgctgttgtagtcggtgatgccgtcgccccagatcacgccgatccactccaggccgcggccgggggcctggcgcacccagttcacgccgtagtcggtcaggctgaagccgctcacggcgcagctcagcttcaggctgccgccgggctgcaccaggccgccgccgctctccagcagcttcacctcgctgccgccgccgctgctgccgccgccgccgctgccgccgccgccgctgccgccgccgccgcgcttcagctccaccttggtgccctggccgaacacccagtggttgctgtaccacagggcgcagaagtaggtggcgaagtcctcgggctgcaggctgctgatggtcagggtggccttgtcgccgatcaggctgccgctgaagcggctgggcacgccgggggcgcggttgttggtgccgccgatcaggcccttgaacagcttgccgggcttctcctgcacccagctggcgtagttgctggtggtcacggcgccggtgctgctgcggcaggtgatggtcacgcggtcgcccacgctggcgctcaggctgctggggctctgggtcatcacgatgtcggggcccataaaccctaggtgttaatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttaccttgatcacggtagagagaattgagagaaagtttttaagattttgagaaattgaaatctgaattgtgaagaagaagagctctttgggtattgttttatagaagaagaagaagaaaagacgaggacgactaggtcacgagaaagctaaggcggtgaagcaatagctaataataaaatgacacgtgtattgagcgttgtttacacgcaaagttgtttttggctaattgccttatttttaggttgaggaaaagtatttgtgctttgagttgataaacacgactcgtgtgtgccggctgcaaccactttgacgccgtttattactgactcgtcgacaaccacaatttctaacggtcgtcataagatccagccgttgagatttaacgatcgttacgatttatatttttttagcattatcgttttattttttaaatatacggtggagctgaaaattggcaataattgaaccgtgggtcccactgcattgaagcgtatttcgtattttctagaattcttcgtgctttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactcatatgcatcctaggaaacaagttgtaatgagttgctggcctctcttgggattgttcatcaaagtagctgtccctacacaccacaacagaatggtgttgtggagagaaagcacagacacatccttgagatggcaagggcacttaagtttcagagtggtgtacctaccaggttttggggagactgtgtcaagactgttgtatacctgatcaatagactccctactccaatcttacaaggcaaatgtccatatgaactactctatcagaaacatgccaagcttgatcacttgagagtgtttgggtgtcttgcttttgcagcaacactgcccaaaggtgacaaacttgcacctagagccaagcgaaccatcttcattggttattctgagactcaaaagggttacaggttgtatgacttggataataaggtgatcatagtgagcagggatgtagttttcagagagtttcagttccctttcaaagagtccatctcccatgaacctgatatgttcactcgagcaggttcacttagctctgaagatacagctttgcagctagtgtataatgatatttttccttccagctttcatactgatgatgatgatactccagttcttattcctgacattgtagaggccaatgaggatatcactttggggactcattctacccaaaatcatatcacttcagctgatgctgcaccttcaggccacctgcatgctcctgcagagtcagttgagtcagctgagcctgacctagcaaatgctgaatttgagcaccatactgctgtagctgatccctctctagttccagcaaacctgcacactagacctaaacgcaatgcaggtcctcccatctggctcaaggactttgtgacactgaacaaaggctctagggatgttccataccctatagccaactatgtttcctatgatcacttgcctgttcactatcaagcttatttgagtgctttctccacttatactgaacctaaatccttcaaagaagcagctcaagatgagaaatggatggaggccatgtcccttgagatacaggctcttgaggataataacacctgggagattgtccctttaccccctggtaaacagcctatagggtccaaatgggtgtacaaaattaaatacaaagctaatggtgaagttgacaggtttaaggcaaggctagtggccaagggatacactcagcaagaaggccttgactaccatgaaactttttctccagtggccaaaatggtcactgtaaaagctgtcatatctgttgctgcttccaagggctggttccttttccagatggatgtcaacaatgcttttctacaaggtgacctcatggaagaagtttatatgtctctgcctcagggttttcacagccaaggggagaccaaagtgtgcaggctgttgaatccctctatggtttaaagcaagcatcaaggcagtggaacatcaagcttaccactgtccttatgcaggctggttttatgcaaagtgcttatgatcactccttgtttaccaaaagagaggggactgaccttgtcataatcctgatttatgtggatgatctgttaataacaggcagcagcaatgttttgatttcagaagcaaaggcaaccctgcatcagcatttcaagatgaaagatttgggagaactaaaatacttcttaggcattgaggtgctgagatcagaaaagggaatcctactgaaccagaggaagtatgcactggaactgatatcaggtgttggtctgggaggctgcagaccagtgtcaaccccaatggaacagaaccaaaggctgactactgtagaatatgacaagcacttaggaaagactgatgatgcagagttagaggatgtgggttcctatcagagactggtgggaaagcttctctacttgacaatcacaaggccagatatcagctttgcagtgcaggtgctgagtcaattcatgcagcaacccaaacagtcacacctggaagcagcattgagggttgtgaagtacataaaaggttctccaggtgttaggaagcggccgcatgcatatgagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagggatcatcaacaagtttgtacaaaaaagcaggctctttaaagtatttttacaacaattaccaacaacaacaaacaacaaacaacattacaattactatttacaattacaaaaaaagttaacatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggaagatgctccaaagaagaagagaaaggtcgacggcattggtagtgggagcaacggcagcagcggatccaacggtccgactgacgccgcggaagaagaacttttgagcaagaattatcatcttgagaacgaagtggctcgtcttaagaaaggttctggcagtggaggttctggctccggaggttccggcggggaagaactgctttcaaagaattaccacctggaaaatgaggtagctagactgaaaaaggggagcggaagtgggggctccgggtcgggcggctctgggggagaggagttgctgagcaaaaattatcatttggagaacgaagtagcacgactaaagaaagggtccggatcgggtggttcaggatctggaggttcgggtggggaggagttactctcgaaaaattatcatctcgaaaacgaagtggctcggctaaaaaagggcagtggttctggaggatctgggtcggggggatccgggggtgaagagctattatctaaaaactaccacctcgaaaatgaggtggcacgcttaaaaaagggaagtggcagtggtgggtcgggatctggcgggtcgggtggagaagagctactatccaagaattatcatcttgagaacgaggtagcgcgtttgaagaagggttccggctcaggaggatctgggtcagggggctcaggaggggaggaactgctctcgaagaactatcatcttgaaaatgaggtcgctcgattaaaaaagggatcgggcagtggtgggtccggctccggtggttcggggggcgaggaactactttcaaagaattaccacctcgaaaacgaagtagctcgattaaagaaaggttcagggtcgggtggctcaggttcgggaggatccggcggtgaagaattactgagtaaaaattatcatctggaaaatgaggtagcgagactaaaaaaggggagtggttctggcggttcgggatctggcgggtcgggaggggaggaattgctatcgaaaaattatcatcttgagaacgaagttgctaggctcaaaaagggctcaggctcaggcgggtccgggtcagggggctcaggtggctaacccgggggcgcgccatgataactagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaag

SEQ ID NO: 164 - protein, 9 aa, Artificial Sequence
  Synthetic Construct
SSGPPPGTG

SEQ ID NO: 165 - protein, 12 aa, Artificial Sequence
  Synthetic Construct
AEAAAKEAAAKA

SEQ ID NO: 166 - protein, 16 aa, Artificial Sequence
  Synthetic Construct
SGSETPGTSESATPES

SEQ ID NO: 167 - DNA, 20 bp, Artificial Sequence
  Synthetic Construct
ttgggtttagtgtttacttg

SEQ ID NO: 168 - DNA, 22 bp, Artificial Sequence
  Synthetic Construct
gaatgttgaatgggataaggta

SEQ ID NO: 169 - DNA, 23 bp, Artificial Sequence
  Synthetic Construct
tgcaatttgtctgcttgctaatg

SEQ ID NO: 170 - DNA, 21 bp, Artificial Sequence
  Synthetic Construct
tcatttataatggacgatgcc

SEQ ID NO: 171 - DNA, 20 bp, Artificial Sequence
  Synthetic Construct
attctcgacggaaagatgta

SEQ ID NO: 172 - DNA, 20 bp, Artificial Sequence
  Synthetic Construct
acggaaagatgtatgggctt

SEQ ID NO: 173 - DNA, 20 bp, Artificial Sequence
  Synthetic Construct
ttcatacgagcgccgctcta

SEQ ID NO: 174 - DNA, 20 bp, Artificial Sequence
  Synthetic Construct
ccattggtccaagtgctatt

SEQ ID NO: 175 - DNA, 20 bp, Artificial Sequence
  Synthetic Construct
gcggcgcaagatctgatatt

SEQ ID NO: 176 - DNA, 20 bp, Artificial Sequence
  Synthetic Construct
aaaactaggccatccatgga

SEQ ID NO: 177 - DNA, 22 bp, Artificial Sequence
  Synthetic Construct
agtgtttcaatcaaggcgtttc

SEQ ID NO: 178 - DNA, 22 bp, Artificial Sequence
  Synthetic Construct
cacccaatggaacaaagtgaac

SEQ ID NO: 179 - DNA, 24 bp, Artificial Sequence
  Synthetic Construct
gtatgagttgcttctccagcaaag

SEQ ID NO: 180 - DNA, 21 bp, Artificial Sequence
  Synthetic Construct
gaggatggctgcaacaagtgt

SEQ ID NO: 181 - DNA, 25 bp, Artificial Sequence
  Synthetic Construct
caggcttgcttttggaaagggtacg

SEQ ID NO: 182 - DNA, 27 bp, Artificial Sequence
  Synthetic Construct
gtgctctctcactcttaaccataagct

SEQ ID NO: 183 - DNA, 24 bp, Artificial Sequence
  Synthetic Construct
gtatgagttgcttctccagcaaag

SEQ ID NO: 184 - DNA, 21 bp, Artificial Sequence
  Synthetic Construct
gaggatggctgcaacaagtgt

SEQ ID NO: 185 - DNA, 22 bp, Artificial Sequence
  Synthetic Construct
agtgtttcaatcaaggcgtttc

SEQ ID NO: 186 - DNA, 22 bp, Artificial Sequence
  Synthetic Construct
cacccaatggaacaaagtgaac

SEQ ID NO: 187 - DNA, 24 bp, Artificial Sequence
  Synthetic Construct
gtatgagttgcttctccagcaaag

SEQ ID NO: 188 - DNA, 21 bp, Artificial Sequence
  Synthetic Construct
gaggatggctgcaacaagtgt

SEQ ID NO: 189 - protein, 3 aa, Artificial Sequence
  Synthetic Construct
  VARIANT 2: Xaa = Any Amino Acid
HXD

SEQ ID NO: 190 - protein, 3 aa, Artificial Sequence
  Synthetic Construct
  VARIANT 2: Xaa = Any Amino Acid
HXR

SEQ ID NO: 191 - protein, 2002 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 192 - protein, 873 aa, Artificial Sequence
  Synthetic Construct
FPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 193 - protein, 1660 aa, Homo sapiens
MDSGPVYHGDSRQLSASGVPVNGAREPAGPSLLGTGGPWRVDQKPDWEAAPGPAHTARLEDAHDLVAFSAVAEAVSSYGALSTRLYETFNREMSREAGNNSRGPRPGPEGCSAGSEDLDTLQTALALARHGMKPPNCNCDGPECPDYLEWLEGKIKSVVMEGGEERPRLPGPLPPGEAGLPAPSTRPLLSSEVPQISPQEGLPLSQSALSIAKEKNISLQTAIAIEALTQLSSALPQPSHSTPQASCPLPEALSPPAPFRSPQSYLRAPSWPVVPPEEHSSFAPDSSAFPPATPRTEFPEAWGTDTPPATPRSSWPMPRPSPDPMAELEQLLGSASDYIQSVFKRPEALPTKPKVKVEAPSSSPAPAPSPVLQREAPTPSSEPDTHQKAQTALQQHLHHKRSLFLEQVHDTSFPAPSEPSAPGWWPPPSSPVPRLPDRPPKEKKKKLPTPAGGPVGTEKAAPGIKPSVRKPIQIKKSRPREAQPLFPPVRQIVLEGLRSPASQEVQAHPPAPLPASQGSAVPLPPEPSLALFAPSPSRDSLLPPTQEMRSPSPMTALQPGSTGPLPPADDKLEELIRQFEAEFGDSFGLPGPPSVPIQDPENQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNFLDENIGGVAVAPAHGSILIECARRELHATTPLKKPNRCHPTRISLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 194 - protein, 971 aa, Artificial Sequence
  Synthetic Construct
FPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNFLDENIGGVAVAPAHGSILIECARRELHATTPLKKPNRCHPTRISLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 195 - DNA, 854 bp, Artificial Sequence
  Synthetic Construct
gttctcatcatataccgaaagaatgggaaatttgaaaattccatacttttttaaaaagacaatttgttttatcactttagtttttttatatattcagcgtctaccaaatctacacttttttttctttctcgatttagttaatcttcgttcttgtgtcatgtaatagattactatttcaaaacatagatatttagttatctaaataaaactaggccatccatggatggtttcaattttttttttcatatgaaagaaaagttaaatttcatttcacaataaccattgattactaaatttagtaaagaatcaattgggtttagtgtttacttgtttaaggttttttttttttcttttgttatggttctatactaatatcaaagagttatgggccgaagcccatacatctttccgtcgagaatctcatatattctttatcgaagcccatacatctttccgtcgagaatctcatatataccttatcccattcaacattcatacgagcgccgctctagggtttttgcttttcgccattggtccaagtgctatttggttgtttaaggttgcttttagcacacaactttaatattatttttatgtttttcttcttacgatttatcgatttgtgggatactgacaatcagattattgttgttttttccagccaaatatcagatcttgcgccgctctttatcccattcaacattcatacgagcaccgctttacggtttttgcttttcgacattggtcgaagtgctatttggttgtttaaggttgcttttagcacacaactttaatattatttttatgttttcttcttacgatttatcgatttgtaggatactgacaatcagatt

SEQ ID NO: 196 - protein, 193 aa, Artificial Sequence
  Synthetic Construct
ELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEK

SEQ ID NO: 197 - protein, 192 aa, Artificial Sequence
  Synthetic Construct
DFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEE

SEQ ID NO: 198 - protein, 192 aa, Artificial Sequence
  Synthetic Construct
EFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEE

SEQ ID NO: 199 - protein, 656 aa, Artificial Sequence
  Synthetic Construct
KLESHLQNLSTLMAPTYKKLAPDAYNNQIEYEHRAPECRLGLKEGRPFSGVTACLDFCAHRDLHNMQNGSTLVCTLTREDNREFGGKPEDEQLHVLPLYKVSDVDEFGSVEAQEEKKRAIQVLSSFRRKVRMLAEPVKTCRQRKLEAKKAAAEKLSSLENSSNKNEKEKSAPSRTKENASQAKQLAELLRLSGPVMQQSQQPQPLQKQPPQPQQQQRPQQQQPHHPQTESVNSYSGSTNPYMRRPNPVSPYPNSSHTSDIYGSTSPMYSTSSQAAGSYLNSSNPMNPYPGNQNTQYPSYQCNGNLSVDNCSPYLGSYSPQSQPMDLYRYPSQDPLSKLPPIHTLYQPRFGNSQSFTSKYLGYGNQNMQGDGFSSIRPNVHHVGKLPPYPTHEMDGHFMGATSRLPPNLSNPNMDYKNGEHPSHIIHNYSAAPGMFNSSLHALHLQNKENDMLSHTANGLSKMLPALNHDRCVQGGLHKLSDANGQEKQPLALVQGVASGAEDNDEVWSEQSFLDPDIGGVAVAPTHGSILIECAKRELHATTPLKNPNRNHPTRISLVFYQHKSMNKHGLALWEAKMAEKAREKEEECEKYGPDYVPQKSHGKKVKREPAEPHETSEPTYLIKSLAERTMSVTTDSTVTTSPYAFTRVTGPYNRYI

SEQ ID NO: 200 - protein, 502 aa, Artificial Sequence
  Synthetic Construct
NLEDNLQSLATRLAPIYKQYAPVAYQNQVEYENVARECRLGSKEGRPFSGVTACLDFCAHRDIHNMNNGSTVVCTLTREDNRSLGVIPQDEQLHVLPLYKLSDTDEFGSKEGMEAKIKAIEVLAPRRKKRTCFTQPVPRSGKKRAAMMTEVLAHKIRAVEKKPIPRIKNNSTTTNNSKPSSLPTLGSNTETVQPEVKSETEPHFILKSSDKTYSLMPSAPHPVKSPGFSWSPKTASATPAPLKNDATASCGFSERSPHCTMPSGRLSGANAAAADGPGISQLGEVAPTLSAPVMEPLINSEPSTGVTEPLTPHQPNHSFLTSPQDLASSPMEEDESEADEPPSDEPLSDDPLSPAEEKLPHIDEYWSEHIFLDANIGGVAIAPAHGSVLIECARRELHATTPVEHPNRNHPTRLSLVFYQHKNLNQHGFELNKIKFEAKEAKNKKMKASEQKDQAANEGPEQSSEVNELIPSHKALTLTHDNVVTVSPYALTHVAGPYNHWV

SEQ ID NO: 201 - protein, 754 aa, Artificial Sequence
  Synthetic Construct
VLRKSFQDLATEVAPLYKRLAPQAYQNQVTNEEIAIDCRLGLKEGRPFAGVTACMDFCAHKDQHNLYNGCTVVCTLTKEDNRCVGKIPEDEQLHVLPLYKMANTDEFGSEENQNAKVGAIQVLTAFPREVRRLPEPAKSCRQRQLEARKAAAEKKKIQKEKLSTPEKIKALELAGITSDPGLSLKGGLSQQGLKPSLKVEPQNHFSSFKYSGNAVVESYLGNCRPSDPYSMNSVYSYHSYYAQPSLTSVNGFHSKYALPSFSYYGFPSSNFPSQFLGPGAWGHSGSSGSFEKKPDLHALHNSLSPAYGGAEFAELPSQAVPTDAHHPTHQQPAYPGPKEYLLPKAPLLHSVSRDPSPFAQSSNCYNRSIKQEPVDPLTQAVPRDAGKMGKTPLSEVSQNGGPSHLWGQYSGGPSMSPKRTNGVGGSWGVFSSGESPVPDKLSSFGASCLAPSHFTDGQWGLFPGEGQQAASHSGGRLRGKPWSPCKFGNSTSALPSLTEKPWALGAGDFNSALKGSPGFQDKLWNPMKGEEGRIPAAGASQLDRAWQSFPLGSSEKLFGALKSEEKLWDPFSLEEGPAEEPPSKGAVKEEKGGGGAEEEEEELWSEHNFLDENIGGVAVAPAHGSILIECARRELHATTPLKKPNRCHPTRISLVFYQHKNLNNHGLALWEAKMKQLAERARARQEEAARLGLGQQEAKLYGKKRKWGGTVVAEPQQKEKKVPTRQALAVPTDSAVTVSSYAYTKVTGPYSRWI

What is claimed is:

1. A method for reducing methylation of a target nucleic acid in a plant, comprising:
    (a) providing a plant comprising a recombinant TET polypeptide that comprises the amino acid sequence of SEQ ID NO: 189 and that is capable of being targeted to a target nucleic acid, wherein the recombinant TET polypeptide comprises an amino acid sequence that is at least 90% identical to an amino acid sequence selected from the group consisting of SEQ ID NO: 8 and SEQ ID NO: 191; and
    (b) growing the plant under conditions whereby the recombinant polypeptide is targeted to the target nucleic acid, thereby reducing methylation of the target nucleic acid.

2. The method of claim 1, wherein the recombinant TET polypeptide is targeted to the target nucleic acid via a SunTag targeting system.

3. The method of claim 1, wherein the recombinant TET polypeptide is targeted to the target nucleic acid via a DNA-binding domain.

4. The method of claim 1, wherein the recombinant TET polypeptide comprises an amino acid sequence that is at least 95% identical to SEQ ID NO: 191.

5. The method of claim 1, wherein the recombinant TET polypeptide comprises an amino acid sequence that is at least 95% identical to SEQ ID NO: 8.

6. The method of claim 1, wherein expression of the target nucleic acid is activated as compared to a corresponding control nucleic acid.

7. A recombinant nucleic acid comprising a plant promoter and which encodes a recombinant polypeptide comprising a DNA-binding domain and a TET polypeptide that comprises the amino acid sequence of SEQ ID NO: 189 and comprises an amino acid sequence that is at least 90% identical to an amino acid sequence selected from the group consisting of SEQ ID NO: 8 and SEQ ID NO: 191.

8. An expression vector comprising the recombinant nucleic acid of claim 7.

9. A host cell comprising the expression vector of claim 8.

10. A recombinant plant comprising the recombinant nucleic acid of claim 7.

11. A recombinant vector comprising:
    a first nucleic acid sequence comprising a plant promoter and that encodes 1) a recombinant polypeptide comprising a nuclease-deficient CAS9 polypeptide (dCAS9) and 2) a multimerized epitope;
    a second nucleic acid sequence comprising a plant promoter and that encodes a recombinant polypeptide comprising 1) a TET polypeptide that comprises the amino acid sequence of SEQ ID NO: 189 and comprises an amino acid sequence that is at least 90% identical to an amino acid sequence selected from the group consisting of SEQ ID NO: 8 and SEQ ID NO: 191, and 2) an affinity polypeptide that specifically binds to the epitope; and
    a third nucleic acid sequence comprising a promoter and that encodes a crRNA and a tracrRNA, or fusions thereof.

12. A host cell comprising the vector of claim 11.

13. A recombinant plant comprising the vector of claim 12.

* * * * *